US012637672B2

(12) United States Patent
Butler et al.

(10) Patent No.: US 12,637,672 B2
(45) Date of Patent: May 26, 2026

(54) OLIGONUCLEOTIDE COMPOSITIONS AND METHODS THEREOF

(71) Applicant: WAVE LIFE SCIENCES LTD., Singapore (SG)

(72) Inventors: David Charles Donnell Butler, Medford, MA (US); Sethumadhavan Divakaramenon, Lexington, MA (US); Christopher J. Francis, Carlisle, MA (US); Maria David Frank-Kamenetsky, Brookline, MA (US); Naoki Iwamoto, Boston, MA (US); Genliang Lu, Winchester, MA (US); Subramanian Marappan, Acton, MA (US); Meena Meena, Belmont, MA (US); Chandra Vargeese, Schwenksville, PA (US); Gregory L. Verdine, Boston, MA (US); Hailin Yang, West Roxbury, MA (US); Jason Jingxin Zhang, Walpole, MA (US)

(73) Assignee: WAVE LIFE SCIENCES LTD., Singapore (SG)

( * ) Notice: Subject to any disclaimer, the term of this patent is extended or adjusted under 35 U.S.C. 154(b) by 0 days.

(21) Appl. No.: 18/062,422

(22) Filed: Dec. 6, 2022

(65) Prior Publication Data

US 2024/0117347 A1 Apr. 11, 2024

Related U.S. Application Data

(62) Division of application No. 15/766,578, filed as application No. PCT/US2016/056123 on Oct. 7, 2016, now abandoned.

(Continued)

(51) Int. Cl.
*C12N 15/113* (2010.01)
*A61K 31/7115* (2006.01)
(Continued)

(52) U.S. Cl.
CPC ........ *C12N 15/113* (2013.01); *A61K 31/7115* (2013.01); *A61K 31/712* (2013.01);
(Continued)

(58) Field of Classification Search
CPC ..... C12N 15/11; C12N 15/111; C12N 15/113; C12N 2310/11; C12N 2310/14;
(Continued)

(56) References Cited

U.S. PATENT DOCUMENTS

| | | | |
|---|---|---|---|
| 5,268,464 | A | 12/1993 | Brill |
| 5,852,188 | A | 12/1998 | Cook |

(Continued)

FOREIGN PATENT DOCUMENTS

| | | | |
|---|---|---|---|
| EA | 010200 | B1 | 6/2008 |
| EP | 1191097 | A1 | 3/2002 |

(Continued)

OTHER PUBLICATIONS

U.S. Appl. No. 17/439,755, filed Sep. 15, 2021, Kandasamy et al.

(Continued)

*Primary Examiner* — Terra C Gibbs
(74) *Attorney, Agent, or Firm* — Choate, Hall & Stewart LLP; Xiaodong Li; Dustin K. Goncharoff

(57) ABSTRACT

Among other things, the present disclosure relates to designed oligonucleotides, compositions, and methods thereof. In some embodiments, provided oligonucleotide compositions provide altered splicing of a transcript. In some embodiments, provided oligonucleotide compositions have low toxicity. In some embodiments, provided oligonucleotide compositions provide improved protein binding (Continued)

profiles. In some embodiments, provided oligonucleotide compositions have improved delivery. In some embodiments, provided oligonucleotide compositions have improved uptake. In some embodiments, the present disclosure provides methods for treatment of diseases using provided oligonucleotide compositions.

12 Claims, 67 Drawing Sheets

Specification includes a Sequence Listing.

Related U.S. Application Data

(60) Provisional application No. 62/331,966, filed on May 4, 2016, provisional application No. 62/331,961, filed on May 4, 2016, provisional application No. 62/239,839, filed on Oct. 9, 2015.

(51) Int. Cl.

| | |
|---|---|
| ***A61K 31/712*** | (2006.01) |
| ***A61K 31/7125*** | (2006.01) |
| ***A61K 48/00*** | (2006.01) |
| ***A61P 21/00*** | (2006.01) |
| ***A61P 25/14*** | (2006.01) |
| ***A61P 27/00*** | (2006.01) |
| ***C07F 9/59*** | (2006.01) |
| ***C07H 21/00*** | (2006.01) |
| ***C07H 21/02*** | (2006.01) |

(52) U.S. Cl.
CPC ...... *A61K 31/7125* (2013.01); *A61K 48/0016* (2013.01); *A61K 48/0066* (2013.01); *A61K 48/0083* (2013.01); *A61P 21/00* (2018.01); *A61P 25/14* (2018.01); *A61P 27/00* (2018.01); *C07F 9/59* (2013.01); *C07H 21/00* (2013.01); *C07H 21/02* (2013.01); *C12N 2310/11* (2013.01); *C12N 2310/315* (2013.01); *C12N 2310/322* (2013.01); *C12N 2310/343* (2013.01); *C12N 2310/346* (2013.01); *C12N 2320/33* (2013.01)

(58) Field of Classification Search
CPC ........ C12N 2310/315; C12N 2310/321; C12N 2310/322; C12N 2310/342; C12N 2310/346; C12N 2310/3521; C12N 2320/33; A61K 31/7112; A61K 31/7115; A61K 31/7125; A61K 48/00; A61K 48/0016; A61K 48/0066; A61P 21/00; A61P 25/14
See application file for complete search history.

(56) References Cited

U.S. PATENT DOCUMENTS

| | | | |
|---|---|---|---|
| 5,856,465 | A | 1/1999 | Stec et al. |
| 6,784,291 | B2 | 8/2004 | Iversen et al. |
| 6,867,294 | B1 | 3/2005 | Sanghvi et al. |
| 7,534,879 | B2 | 5/2009 | van Deutekom |
| 7,598,227 | B2 | 10/2009 | Crooke et al. |
| 7,750,141 | B2 | 7/2010 | Crooke et al. |
| 7,807,816 | B2 | 10/2010 | Wilton et al. |
| 7,960,541 | B2 | 6/2011 | Wilton et al. |
| 7,973,015 | B2 | 7/2011 | Van Ommen et al. |
| 8,084,601 | B2 | 12/2011 | Popplewell et al. |
| 8,232,384 | B2 | 7/2012 | Wilton et al. |
| 8,436,163 | B2 | 5/2013 | Iversen et al. |
| 8,450,474 | B2 | 5/2013 | Wilton et al. |
| 8,455,634 | B2 | 6/2013 | Wilton et al. |
| 8,455,635 | B2 | 6/2013 | Wilton et al. |
| 8,455,636 | B2 | 6/2013 | Wilton et al. |
| 8,470,987 | B2 | 6/2013 | Wada et al. |
| 8,476,423 | B2 | 7/2013 | Wilton et al. |
| 8,486,907 | B2 | 7/2013 | Wilton et al. |
| 8,524,880 | B2 | 9/2013 | Wilton et al. |
| 8,530,439 | B2 | 9/2013 | Crooke et al. |
| 8,729,036 | B2 | 5/2014 | Zamore et al. |
| 8,759,507 | B2 | 6/2014 | Van Deutekom |
| 8,822,671 | B2 | 9/2014 | Shimizu et al. |
| 8,859,755 | B2 | 10/2014 | Wada et al. |
| 8,895,722 | B2 | 11/2014 | Iversen et al. |
| 9,018,368 | B2 | 4/2015 | Wilton et al. |
| 9,024,007 | B2 | 5/2015 | Wilton et al. |
| 9,035,040 | B2 | 5/2015 | Wilton et al. |
| 9,079,934 | B2 | 7/2015 | Watanabe et al. |
| 9,157,082 | B2 | 10/2015 | Mullick et al. |
| 9,175,286 | B2 | 11/2015 | Wilton et al. |
| 9,243,245 | B2 | 1/2016 | De Kimpe et al. |
| 9,243,251 | B2 | 1/2016 | Popplewell et al. |
| 9,249,416 | B2 | 2/2016 | Wilton et al. |
| 9,365,848 | B2 | 6/2016 | Crooke et al. |
| 9,382,540 | B2 | 7/2016 | Prakash et al. |
| 9,394,333 | B2 | 7/2016 | Wada et al. |
| 9,416,361 | B2 | 8/2016 | Iversen et al. |
| 9,422,555 | B2 | 8/2016 | Wilton et al. |
| 9,441,229 | B2 | 9/2016 | Wilton et al. |
| 9,447,415 | B2 | 9/2016 | Wilton et al. |
| 9,476,044 | B2 | 10/2016 | Tuschl et al. |
| 9,506,058 | B2 | 11/2016 | Kaye |
| 9,512,424 | B2 | 12/2016 | Watanabe et al. |
| 9,598,458 | B2 | 3/2017 | Shimizu et al. |
| 9,605,019 | B2 | 3/2017 | Verdine et al. |
| 9,605,262 | B2 | 3/2017 | Wilton et al. |
| 9,617,547 | B2 | 4/2017 | Gemba |
| 9,624,496 | B2 | 4/2017 | Crooke et al. |
| 9,650,632 | B2 | 5/2017 | Popplewell et al. |
| 9,695,211 | B2 | 7/2017 | Wada et al. |
| 9,708,361 | B2 | 7/2017 | Watanabe et al. |
| 9,744,183 | B2 | 8/2017 | Verdine et al. |
| 9,840,706 | B2 | 12/2017 | Watanabe et al. |
| 9,890,381 | B2 | 2/2018 | Watanabe et al. |
| 9,896,687 | B2 | 2/2018 | van Ommen et al. |
| 9,982,257 | B2 | 5/2018 | Butler et al. |
| 9,988,629 | B2 | 6/2018 | Wakayama et al. |
| 10,100,304 | B2 | 10/2018 | Van Deutekom |
| 10,144,931 | B2 | 12/2018 | Enya et al. |
| 10,144,933 | B2 | 12/2018 | Gemba et al. |
| 10,149,905 | B2 | 12/2018 | Gemba et al. |
| 10,160,969 | B2 | 12/2018 | Meena et al. |
| 10,167,309 | B2 | 1/2019 | Shimizu et al. |
| 10,280,192 | B2 | 5/2019 | Verdine et al. |
| 10,307,434 | B2 | 6/2019 | Verdine et al. |
| 10,322,173 | B2 | 6/2019 | Gemba et al. |
| 10,329,318 | B2 | 6/2019 | Wada et al. |
| 10,428,019 | B2 | 10/2019 | Wada et al. |
| 10,450,568 | B2 | 10/2019 | Butler et al. |
| 10,479,995 | B2 | 11/2019 | Vargeese et al. |
| 10,590,413 | B2 | 3/2020 | Butler et al. |
| 10,696,711 | B2 | 6/2020 | Shimizu et al. |
| 10,724,035 | B2 | 7/2020 | Vargeese et al. |
| 10,815,482 | B2 | 10/2020 | Meena et al. |
| 11,013,757 | B2 | 5/2021 | Zhang et al. |
| 11,136,346 | B2 | 10/2021 | Shimizu et al. |
| 11,407,775 | B2 | 8/2022 | Butler et al. |
| 11,596,646 | B2 | 3/2023 | Zhang et al. |
| 11,597,927 | B2 | 3/2023 | Vargeese et al. |
| 11,603,532 | B2 | 3/2023 | Vargeese et al. |
| 11,608,355 | B2 | 3/2023 | Bowman et al. |
| 11,634,710 | B2 | 4/2023 | Frank-Kamenetsky et al. |
| 11,643,657 | B2 | 5/2023 | Butler et al. |
| 11,718,638 | B2 | 8/2023 | Butler et al. |
| 11,739,325 | B2 | 8/2023 | Vargeese et al. |
| 11,873,316 | B2 | 1/2024 | Butler et al. |
| 2002/0042387 | A1 | 4/2002 | Raz et al. |
| 2002/0082227 | A1 | 6/2002 | Henry |
| 2002/0137921 | A1 | 9/2002 | Cook |
| 2002/0142980 | A1 | 10/2002 | Thompson et al. |
| 2003/0235845 | A1 | 12/2003 | van Ommen et al. |

(56) References Cited

U.S. PATENT DOCUMENTS

| | | | |
|---|---|---|---|
| 2004/0126752 | A1 | 7/2004 | Gryaznov et al. |
| 2004/0208856 | A1 | 10/2004 | Crooke et al. |
| 2004/0214325 | A1 | 10/2004 | Crooke et al. |
| 2004/0266720 | A1 | 12/2004 | Iversen et al. |
| 2006/0099616 | A1 | 5/2006 | van Ommen et al. |
| 2006/0147952 | A1 | 7/2006 | van Ommen et al. |
| 2006/0264395 | A1 | 11/2006 | Crooke et al. |
| 2007/0155854 | A1 | 7/2007 | Brunner et al. |
| 2008/0119426 | A1 | 5/2008 | Dale |
| 2008/0200409 | A1 | 8/2008 | Wilson et al. |
| 2008/0209581 | A1 | 8/2008 | van Ommen et al. |
| 2009/0076246 | A1 | 3/2009 | van Deutekom |
| 2009/0228998 | A1 | 9/2009 | Van Ommen et al. |
| 2010/0008937 | A1 | 1/2010 | Peer et al. |
| 2010/0125099 | A1 | 5/2010 | 'T Hoen et al. |
| 2010/0168212 | A1 | 7/2010 | Popplewell et al. |
| 2011/0015253 | A1 | 1/2011 | Wilton et al. |
| 2011/0015258 | A1 | 1/2011 | Wilton et al. |
| 2011/0046203 | A1 | 2/2011 | Wilton et al. |
| 2011/0178284 | A1 | 7/2011 | Wada et al. |
| 2011/0263682 | A1 | 10/2011 | De Kimpe et al. |
| 2011/0263686 | A1 | 10/2011 | Wilton et al. |
| 2011/0269814 | A1 | 11/2011 | Manoharan et al. |
| 2011/0294124 | A1 | 12/2011 | Wada et al. |
| 2011/0312086 | A1 | 12/2011 | Van Deutekom |
| 2012/0022134 | A1 | 1/2012 | De Kimpe et al. |
| 2012/0022144 | A1 | 1/2012 | Wilton et al. |
| 2012/0022145 | A1 | 1/2012 | Wilton et al. |
| 2012/0029057 | A1 | 2/2012 | Wilton et al. |
| 2012/0029058 | A1 | 2/2012 | Wilton et al. |
| 2012/0029059 | A1 | 2/2012 | Wilton et al. |
| 2012/0029060 | A1 | 2/2012 | Wilton et al. |
| 2012/0041050 | A1 | 2/2012 | Wilton et al. |
| 2012/0059042 | A1 | 3/2012 | Platenburg et al. |
| 2012/0065224 | A1 | 3/2012 | Kim et al. |
| 2012/0108652 | A1 | 5/2012 | Popplewell et al. |
| 2012/0156138 | A1 | 6/2012 | Smith |
| 2012/0202752 | A1 | 8/2012 | Lu |
| 2012/0316224 | A1 | 12/2012 | Verdine et al. |
| 2013/0072671 | A1 | 3/2013 | Van Deutekom |
| 2013/0116310 | A1 | 5/2013 | Wilton et al. |
| 2013/0178612 | A1 | 7/2013 | Wada et al. |
| 2013/0184450 | A1 | 7/2013 | Wada et al. |
| 2013/0190390 | A1 | 7/2013 | Sazani et al. |
| 2013/0217755 | A1 | 8/2013 | Wilton et al. |
| 2013/0253033 | A1 | 9/2013 | Wilton et al. |
| 2013/0253178 | A1 | 9/2013 | Shimizu et al. |
| 2013/0253180 | A1 | 9/2013 | Wilton et al. |
| 2013/0274313 | A1 | 10/2013 | Wilton et al. |
| 2013/0289092 | A1 | 10/2013 | Rigo et al. |
| 2013/0302806 | A1 | 11/2013 | Van Deutekom |
| 2013/0331438 | A1 | 12/2013 | Wilton et al. |
| 2014/0080896 | A1 | 3/2014 | Nelson et al. |
| 2014/0080898 | A1 | 3/2014 | Wilton et al. |
| 2014/0113955 | A1 | 4/2014 | De Kimpe et al. |
| 2014/0135283 | A1 | 5/2014 | Cashman et al. |
| 2014/0155587 | A1 | 6/2014 | Wilton et al. |
| 2014/0194610 | A1 | 7/2014 | Verdine et al. |
| 2014/0213635 | A1 | 7/2014 | Van Deutekom |
| 2014/0221458 | A1 | 8/2014 | De Kimpe et al. |
| 2014/0243515 | A1 | 8/2014 | Wilton et al. |
| 2014/0243516 | A1 | 8/2014 | Wilton et al. |
| 2014/0275212 | A1 | 9/2014 | van Deutekom |
| 2014/0309283 | A1 | 10/2014 | Wilton et al. |
| 2014/0309284 | A1 | 10/2014 | Wilton et al. |
| 2014/0309285 | A1 | 10/2014 | Wilton et al. |
| 2014/0315862 | A1 | 10/2014 | Kaye |
| 2014/0350076 | A1 | 11/2014 | van Deutekom |
| 2014/0357698 | A1 | 12/2014 | Van Deutekom et al. |
| 2014/0357855 | A1 | 12/2014 | Van Deutekom et al. |
| 2014/0378527 | A1 | 12/2014 | van Deutekom |
| 2015/0018540 | A1 | 1/2015 | Prakash et al. |
| 2015/0057330 | A1 | 2/2015 | Wilton et al. |
| 2015/0080563 | A2 | 3/2015 | van Deutekom |
| 2015/0094356 | A1 | 4/2015 | Collard et al. |
| 2015/0166999 | A1 | 6/2015 | Gemba |
| 2015/0197540 | A1 | 7/2015 | Shimizu et al. |
| 2015/0211006 | A1 | 7/2015 | Butler et al. |
| 2015/0218559 | A1 | 8/2015 | Van Deutekom et al. |
| 2015/0322434 | A1 | 11/2015 | van Deutekom |
| 2015/0353931 | A1 | 12/2015 | Wilton et al. |
| 2015/0361424 | A1 | 12/2015 | van Deutekom |
| 2015/0376615 | A1 | 12/2015 | Wilton et al. |
| 2015/0376616 | A1 | 12/2015 | Wilton et al. |
| 2015/0376624 | A1 | 12/2015 | Gryaznov et al. |
| 2016/0002631 | A1 | 1/2016 | Wilton et al. |
| 2016/0002632 | A1 | 1/2016 | Wilton et al. |
| 2016/0002635 | A1 | 1/2016 | Wilton et al. |
| 2016/0040161 | A1 | 2/2016 | Packard et al. |
| 2016/0060625 | A1 | 3/2016 | Mullick et al. |
| 2016/0168570 | A1 | 6/2016 | Van Deutekom et al. |
| 2016/0177301 | A1 | 6/2016 | Wilton et al. |
| 2016/0194349 | A1 | 7/2016 | Prakash et al. |
| 2016/0194636 | A1 | 7/2016 | Van Deutekom et al. |
| 2016/0251658 | A1 | 9/2016 | Van Deutekom et al. |
| 2016/0264964 | A1 | 9/2016 | Cancilla et al. |
| 2016/0289677 | A1 | 10/2016 | Albaek et al. |
| 2016/0331835 | A1 | 11/2016 | Gemba et al. |
| 2016/0331836 | A1 | 11/2016 | Gemba et al. |
| 2016/0333349 | A1 | 11/2016 | Gemba et al. |
| 2016/0347780 | A1 | 12/2016 | Wada et al. |
| 2016/0347784 | A1 | 12/2016 | Verdine et al. |
| 2016/0355810 | A1 | 12/2016 | Van Deutekom |
| 2017/0009233 | A1 | 1/2017 | Wilton et al. |
| 2017/0009234 | A1 | 1/2017 | Wilton et al. |
| 2017/0029445 | A1 | 2/2017 | Shimizu et al. |
| 2017/0029457 | A1 | 2/2017 | Verdine et al. |
| 2017/0029818 | A1 | 2/2017 | de Visser et al. |
| 2017/0037399 | A1 | 2/2017 | Meena et al. |
| 2017/0107512 | A1 | 4/2017 | De Kimpe et al. |
| 2017/0159050 | A1 | 6/2017 | Iversen et al. |
| 2017/0204413 | A1 | 7/2017 | Popplewell et al. |
| 2017/0268003 | A1 | 9/2017 | Van Deutekom |
| 2017/0268004 | A1 | 9/2017 | Mullick et al. |
| 2017/0275621 | A1 | 9/2017 | Butler et al. |
| 2017/0275624 | A1 | 9/2017 | Van Deutekom |
| 2017/0320903 | A1 | 11/2017 | Watanabe et al. |
| 2017/0369876 | A1 | 12/2017 | Bestwick et al. |
| 2018/0044675 | A1 | 2/2018 | Watanabe et al. |
| 2018/0051282 | A1 | 2/2018 | Wilton et al. |
| 2018/0105811 | A1 | 4/2018 | Kaye |
| 2018/0111958 | A1 | 4/2018 | Wada et al. |
| 2018/0142245 | A1 | 5/2018 | Watanabe et al. |
| 2018/0171333 | A1 | 6/2018 | Wilton et al. |
| 2018/0179538 | A1 | 6/2018 | Wakayama et al. |
| 2018/0216107 | A1 | 8/2018 | Frank-Kamenetsky et al. |
| 2018/0216108 | A1 | 8/2018 | Vargeese et al. |
| 2018/0222936 | A1 | 8/2018 | Verdine et al. |
| 2018/0237773 | A1 | 8/2018 | Iversen et al. |
| 2018/0251760 | A1 | 9/2018 | Nakagawa et al. |
| 2019/0008986 | A1 | 1/2019 | Butler et al. |
| 2019/0106696 | A1 | 4/2019 | Meena et al. |
| 2019/0127733 | A1 | 5/2019 | Butler et al. |
| 2019/0209604 | A1 | 7/2019 | Zhang et al. |
| 2019/0249173 | A1 | 8/2019 | Vargeese et al. |
| 2019/0264267 | A1 | 8/2019 | Yang et al. |
| 2019/0375774 | A1 | 12/2019 | Butler et al. |
| 2019/0390197 | A1 | 12/2019 | Butler et al. |
| 2020/0080083 | A1 | 3/2020 | Vargeese et al. |
| 2020/0157545 | A1 | 5/2020 | Vargeese et al. |
| 2020/0190515 | A1 | 6/2020 | Vargeese et al. |
| 2020/0231620 | A1 | 7/2020 | Bowman et al. |
| 2020/0299692 | A1 | 9/2020 | Frank-Kamenetsky et al. |
| 2020/0362337 | A1 | 11/2020 | Dodart et al. |
| 2020/0385420 | A1 | 12/2020 | Shimizu et al. |
| 2021/0032620 | A1 | 2/2021 | Vargeese et al. |
| 2021/0115444 | A1 | 4/2021 | Meena et al. |
| 2021/0130821 | A1 | 5/2021 | Butler et al. |
| 2021/0198305 | A1 | 7/2021 | Vargeese et al. |
| 2021/0228615 | A1 | 7/2021 | Zhang et al. |
| 2021/0254062 | A1 | 8/2021 | Zhang et al. |
| 2022/0098585 | A1 | 3/2022 | Brown et al. |
| 2022/0127301 | A1 | 4/2022 | Shimizu et al. |
| 2022/0145300 | A1 | 5/2022 | Liu et al. |

(56) References Cited

U.S. PATENT DOCUMENTS

| | | | |
|---|---|---|---|
| 2022/0162598 | A1 | 5/2022 | Vargeese et al. |
| 2022/0186217 | A1 | 6/2022 | Zhang et al. |
| 2022/0195429 | A1 | 6/2022 | Vargeese et al. |
| 2022/0356204 | A1 | 11/2022 | Butler et al. |
| 2023/0089442 | A1 | 3/2023 | Kandasamy et al. |
| 2023/0136645 | A1 | 5/2023 | Butler et al. |
| 2023/0145795 | A1 | 5/2023 | Byrne et al. |
| 2023/0203087 | A1 | 6/2023 | Kandasamy et al. |
| 2023/0220384 | A1 | 7/2023 | Monian et al. |
| 2023/0295617 | A1 | 9/2023 | Vargeese et al. |
| 2023/0295619 | A1 | 9/2023 | Maguire et al. |
| 2023/0329201 | A1 | 10/2023 | Yang et al. |
| 2023/0348524 | A1 | 11/2023 | Bowman et al. |
| 2023/0392137 | A1 | 12/2023 | Monian et al. |
| 2024/0026358 | A1 | 1/2024 | Monian et al. |
| 2024/0109931 | A1 | 4/2024 | Vargeese et al. |
| 2024/0132894 | A1 | 4/2024 | Vargeese et al. |
| 2024/0150756 | A1 | 5/2024 | Frank-Kamenetsky et al. |
| 2024/0174710 | A1 | 5/2024 | Butler et al. |
| 2024/0175016 | A1 | 5/2024 | Liu et al. |
| 2024/0175018 | A1 | 5/2024 | Vargeese et al. |
| 2024/0229026 | A1 | 7/2024 | Butler et al. |
| 2024/0368207 | A1 | 11/2024 | Butler et al. |
| 2025/0051778 | A1 | 2/2025 | Byrne et al. |
| 2025/0066775 | A1 | 2/2025 | Vargeese et al. |
| 2025/0135036 | A1 | 5/2025 | Acker et al. |

FOREIGN PATENT DOCUMENTS

| | | | |
|---|---|---|---|
| EP | 1619249 | A1 | 1/2006 |
| EP | 2607484 | A1 | 6/2013 |
| EP | 1606407 | B1 | 12/2013 |
| EP | 2813570 | A1 | 12/2014 |
| EP | 3133160 | A1 | 2/2017 |
| EP | 3400948 | A1 | 11/2018 |
| EP | 3404100 | A1 | 11/2018 |
| JP | 2002-520420 | A | 7/2002 |
| JP | 2003-238586 | A | 8/2003 |
| JP | 2011-184318 | A | 9/2011 |
| JP | 2015-522275 | A | 8/2015 |
| WO | WO-1990/010448 | A2 | 9/1990 |
| WO | WO-1999/01579 | A1 | 1/1999 |
| WO | WO-00/04034 | A2 | 1/2000 |
| WO | WO-2001/083740 | A2 | 11/2001 |
| WO | WO-02/24906 | A1 | 3/2002 |
| WO | WO-2004/003176 | A2 | 1/2004 |
| WO | WO-2004/044134 | A2 | 5/2004 |
| WO | WO-2004/083432 | A1 | 9/2004 |
| WO | WO-2004/083446 | A2 | 9/2004 |
| WO | WO-2004/093783 | A2 | 11/2004 |
| WO | WO-2005/014609 | A2 | 2/2005 |
| WO | WO-2005/023828 | A1 | 3/2005 |
| WO | WO-2005/023994 | A2 | 3/2005 |
| WO | WO-2005/028494 | A1 | 3/2005 |
| WO | WO-2005/070859 | A1 | 8/2005 |
| WO | WO-2005/085272 | A1 | 9/2005 |
| WO | WO-2005/092909 | A1 | 10/2005 |
| WO | WO-2006/000057 | A1 | 1/2006 |
| WO | WO-2006/112705 | A2 | 10/2006 |
| WO | WO-2007/123402 | A2 | 11/2007 |
| WO | WO-2008/147438 | A2 | 12/2008 |
| WO | WO-2009/054725 | A2 | 4/2009 |
| WO | WO-2009/139630 | A2 | 11/2009 |
| WO | WO-2010/045405 | A1 | 4/2010 |
| WO | WO-2010/048586 | A1 | 4/2010 |
| WO | WO-2010/050801 | A1 | 5/2010 |
| WO | WO-2010/050802 | A2 | 5/2010 |
| WO | WO-2010/064146 | A2 | 6/2010 |
| WO | WO-2010/115993 | A1 | 10/2010 |
| WO | WO-2011/005761 | A1 | 1/2011 |
| WO | WO-2011/034072 | A1 | 3/2011 |
| WO | WO-2011/064552 | A1 | 6/2011 |
| WO | WO-2011/078797 | A2 | 6/2011 |
| WO | WO-2011/108682 | A1 | 9/2011 |
| WO | WO-2011/109427 | A2 | 9/2011 |
| WO | WO-2011/126903 | A2 | 10/2011 |
| WO | WO-2011/159836 | A2 | 12/2011 |
| WO | WO-2012/029986 | A1 | 3/2012 |
| WO | WO-2012/039448 | A1 | 3/2012 |
| WO | WO-2012/073857 | A1 | 6/2012 |
| WO | WO-2012/109296 | A1 | 8/2012 |
| WO | WO-2012/149495 | A1 | 11/2012 |
| WO | WO-2013/012758 | A1 | 1/2013 |
| WO | WO-2013/033230 | A1 | 3/2013 |
| WO | WO-2013/112053 | A1 | 8/2013 |
| WO | WO-2014/007620 | A2 | 1/2014 |
| WO | WO-2014/010250 | A1 | 1/2014 |
| WO | WO-2014/010718 | A1 | 1/2014 |
| WO | WO-2014/012081 | A2 | 1/2014 |
| WO | WO-2014/076195 | A1 | 5/2014 |
| WO | WO-2014/076196 | A1 | 5/2014 |
| WO | WO-2014/118272 | A1 | 8/2014 |
| WO | WO-2014/144978 | A2 | 9/2014 |
| WO | WO-2014/207232 | A1 | 12/2014 |
| WO | WO-2015/010135 | A2 | 1/2015 |
| WO | WO-2015/071388 | A1 | 5/2015 |
| WO | WO-2015/107425 | A2 | 7/2015 |
| WO | WO-2015/108046 | A1 | 7/2015 |
| WO | WO-2015/108047 | A1 | 7/2015 |
| WO | WO-2015/108048 | A1 | 7/2015 |
| WO | WO-2016/028187 | A1 | 2/2016 |
| WO | WO-2016/081444 | A1 | 5/2016 |
| WO | WO-2017/015555 | A1 | 1/2017 |
| WO | WO-2017/015575 | A1 | 1/2017 |
| WO | WO-2017/048620 | A1 | 3/2017 |
| WO | WO-2017/052999 | A1 | 3/2017 |
| WO | WO-2017/062862 | A2 | 4/2017 |
| WO | WO-2017/160741 | A1 | 9/2017 |
| WO | WO-2017/192664 | A1 | 11/2017 |
| WO | WO-2017/192679 | A1 | 11/2017 |
| WO | WO-2017/210647 | A1 | 12/2017 |
| WO | WO-2018/007475 | A1 | 1/2018 |
| WO | WO-2018/014042 | A1 | 1/2018 |
| WO | WO-2018/022473 | A1 | 2/2018 |
| WO | WO-2018/056871 | A1 | 3/2018 |
| WO | WO-2018/067973 | A1 | 4/2018 |
| WO | WO-2018/098264 | A1 | 5/2018 |
| WO | WO-2018/156056 | A1 | 8/2018 |
| WO | WO-2018/223056 | A1 | 12/2018 |
| WO | WO-2018/223073 | A1 | 12/2018 |
| WO | WO-2018/223081 | A1 | 12/2018 |
| WO | WO-2018/237194 | A1 | 12/2018 |
| WO | WO-2019/002237 | A1 | 1/2019 |
| WO | WO-2019/032607 | A1 | 2/2019 |
| WO | WO-2019/032612 | A1 | 2/2019 |
| WO | WO-2019/055951 | A1 | 3/2019 |
| WO | WO-2019/075357 | A1 | 4/2019 |
| WO | WO-2019/200185 | A1 | 10/2019 |
| WO | WO-2019/217784 | A1 | 11/2019 |
| WO | WO-2020/118246 | A1 | 6/2020 |
| WO | WO-2020/160336 | A1 | 8/2020 |
| WO | WO-2020/191252 | A1 | 9/2020 |
| WO | WO-2020/196662 | A1 | 10/2020 |
| WO | WO-2020/219981 | A2 | 10/2020 |
| WO | WO-2020/219983 | A2 | 10/2020 |
| WO | WO-2020/227691 | A2 | 11/2020 |
| WO | WO-2021/071788 | A2 | 4/2021 |
| WO | WO-2021/071858 | A1 | 4/2021 |
| WO | WO-2021/178237 | A2 | 9/2021 |
| WO | WO-2021/234459 | A2 | 11/2021 |
| WO | WO-2021/237223 | A1 | 11/2021 |
| WO | WO-2022/046667 | A1 | 3/2022 |
| WO | WO-2022/046723 | A1 | 3/2022 |
| WO | WO-2022/099159 | A1 | 5/2022 |
| WO | WO-2023/049475 | A1 | 3/2023 |
| WO | WO-2023/049477 | A2 | 3/2023 |
| WO | WO-2023/075766 | A1 | 5/2023 |
| WO | WO-2023/076352 | A2 | 5/2023 |
| WO | WO-2023/154528 | A1 | 8/2023 |
| WO | WO-2023/168014 | A2 | 9/2023 |
| WO | WO-2023/201095 | A2 | 10/2023 |
| WO | WO-2023/220440 | A1 | 11/2023 |
| WO | WO-2024/035946 | A1 | 2/2024 |
| WO | WO-2025/030155 | A1 | 2/2025 |

(56) References Cited

FOREIGN PATENT DOCUMENTS

WO WO-2025/072685 A1 4/2025
WO WO-2025/072862 A1 4/2025
WO WO-2025/072879 A1 4/2025
WO WO-2025/072881 A2 4/2025
WO WO-2025/072883 A2 4/2025
WO WO-2025/072886 A1 4/2025

OTHER PUBLICATIONS

U.S. Appl. No. 17/605,997, filed Oct. 22, 2021, Byrne et al.
U.S. Appl. No. 17/605,998, filed Oct. 22, 2021, Byrne et al.
U.S. Appl. No. 17/766,677, filed Apr. 5, 2022, Monlan et al.
U.S. Appl. No. 17/766,680, filed Apr. 5, 2022, Liu et al.
U.S. Appl. No. 17/881,956, filed Aug. 5, 2022, Butler et al.
U.S. Appl. No. 17/907,895, filed Aug. 29, 2022, Maguire et al.
U.S. Appl. No. 17/953,292, filed Sep. 26, 2022, Monian et al.
U.S. Appl. No. 17/956,741, filed Sep. 29, 2022, Vargeese et al.
U.S. Appl. No. 17/960,090, filed Oct. 4, 2022, Vargeese et al.
U.S. Appl. No. 18/022,509, filed Feb. 21, 2023, Yang et al.
U.S. Appl. No. 18/062,422, filed Dec. 6, 2022, Butler et al.
U.S. Appl. No. 18/072,296, filed Nov. 30, 2022, Vargeese et al.
Aaronson, J.G. et al., Rapid HATU-Mediated Solution Phase siRNA Conjugation, Bioconjugate. Chem., 22: 1723-1728 (2011).
Aartsma-Rus, A. et al., Antisense-Induced Multiexon Skipping for Duchenne Muscular Dystrophy Makes More Sense, Am. J. Hum. Genet., 74:83-92 (2004).
Aartsma-Rus, A. et al., Targeted exon skipping as a potential gene correction therapy for Duchenne muscular dystrophy, Neuromuscular Disorders, 12: S71-S77 (2002).
Aartsma-Rus, A. et al., Therapeutic antisense-induced exon skipping in cultured muscle cells from six different DMD patients, Human Molecular Genetics, 12(8):907-914 (2003).
Adarsh, et al., Organelle Specific Targeted Drug Delivery—A Review, International Journal of Research in Pharmaceutical and Biomedical Sciences, 2(3): 895-912 (2011).
Anthony, K. et al., Exon Skipping Quantification by Quantitative Reverse-Transcription Polymerase Chain Reaction in Duchenne Muscular Dystrophy Patients Treated with the Antisense Oligomer Eteplirsen, Human Gene Therapy Methods, 23: 336-345 (2012).
Antonijevic, I. Stereopure exon skipping oligonucleotides in development for the treatment of Duchenne muscular dystrophy (DMD), Paper presented at: New Directions in Biology and Disease of Skeletal Muscle Conference, New Orleans, LA USA (Jun. 25, 2018).
Asari, F. et al., Turbinaric Acid, A Cytotoxic Secosqualene Carboxylic Acid from the Brown Alga Turbinaria Ornata, Journal of Natural Products, 52(5): 1167-1169 (1989).
Belikov, V.G., Pharmaceutical Chemistry, MEDpress-inform, textbook (Russian), 27-29 (2007).
Bolno, P. Wave Life Sciences. Paper presented at: The 2018 Parent Project Muscular Dystrophy Annual Conference, Scottsdale, AZ USA (Jun. 29, 2018).
Bologna, J. et al., Uptake and Quantification of Intracellular Concentration of Lipophilic Pro-Oligonucleotides in HeLa Cells, Antisense and Nucleic Acid Drug Development, 12(1):33-41 (2002).
Bruno, I.G. et al., Correction of aberrant FGFR1 alternative RNA splicing through targeting of intronic regulatory elements, Hum. Mole. Gene., 13(20):2409-2420 (2004).
Bundgaard, H., (C) Means to Enhance Penetration. (1) Prodrugs as a means to improve the delivery of peptide drugs, Advanced Drug Delivery Reviews, 8:1-38 (1992).
Bunnell. B.A. et al., Targeted Delivery of Antisense Oligonucleotides by Molecular Conjugates, Somatic Cell and Molecular Genetics, 18(6):559-569 (1992).
Dietz, G.P.H. et al., Delivery of bioactive molecules into the cell: the Trojan horse approach, Molecular and Cellular Neuroscience, 27(2): 85-131 (2004).
Durbin, A. et al., Identification of potent, muscle-targeting investigational stereo-pure oligonucleotides for exon 53 DMD therapy, Neuromuscul Disord., 28: S67, p. 127 Abstract (2018).
Durbin, A. et al., Identification of potent, muscle-targeting investigational stereo-pure oligonucleotides for exon 53 DMD therapy. Poster presented at: the 23rd International Congress of the World Muscle Society, Mendoza, Argentina (Oct. 3, 2018).
Erler, W. et al., Patient Advisory Board Meeting, WAVE Life Sciences, London, 46 pages (Mar. 2, 2017).
Erler, W. Exon skipping. Paper presented at: Parent Project Muscular Dystrophy Annual Connect Conference, Chicago, IL USA (Jul. 1, 2017).
Erler, W. Stereopure exon 51-skipping oligonucleotide as a potential disease-modifying therapy for Duchenne muscular dystrophy. Paper presented at: 15th International Conference on Duchenne and Becker Muscular Dystrophy, Rome, Italy (Feb. 18, 2017).
Erler, W. Wave Life Sciences: Stereopure exon skipping approach for the potential treatment of DMD. Paper presented at: Paper presented at: 16th International Conference on Duchenne and Becker Muscular Dystrophy, Rome, Italy (Feb. 14, 2018).
Erler, W. Wave Life Sciences: study. Paper presented at: Action Duchenne 16th International Conference, Birmingham, UK, (Nov. 9-11, 2017).
Erler, W., Stereopure Exon 51-Skipping Oligonucleotide as a Potential Disease-Modifying Therapy for Duchenne Muscular Dystrophy, WAVE Life Sciences, 10 pages (2017).
Fokina, A. et al., Analysis of new charge-neutral DNA/RNA analogues phosphoryl guanidine oligonucleotides (PGO) by gel electrophoresis, Analytical Biochemistry, 555: 9-11 (2018).
Forefront of Nucleic Acid Medicine, CMC Publishing C., Ltd. (2014), Textbook (Japanese), pp. 14-17 and 76-77.
Hammond, S.M. and Wood, M.J. Genetic therapies for RNA mis-splicing diseases, Trends Genet., 27: 196-205 (2011).
Heemskerk, H.A. et al., In vivo comparison of 2'-O-methyl phosphorothioate and morpholino antisense oligonucleotides for Duchenne muscular dystrophy exon skipping, The Journal of Gene Medicine, 11:257-266 (2009).
Herholdt, C. Clinical Trial Panel: Wave Life Sciences study. Paper presented at: Action Duchenne 16th International Conference, Birmingham, UK (Nov. 9-11, 2017).
Hitchman, S. et al., A Phase 1 clinical trial of an investigational stereopure oligonucleotide, WVE-210201, in patients with Duchenne muscular dystrophy. Poster presented at: The Parent Project Muscular Dystrophy Annual Conference, Scottsdale, AZ USA (Jun. 28-Jul. 1, 2018).
Hung, S. Stereopure oligonucleotides as a therapeutic approach to rare neurological diseases. Paper presented at: Huntington's Society of Canada 2017 National Conference (Nov. 2017).
International Search Report for PCT/US2016/056123, 5 pages (Mar. 17, 2017).
International Search Report for PCT/US2017/030777, 5 pages (Oct. 2, 2017).
International Search Report for PCT/US2017/055601, ISR/US, 6 pages (mailed Feb. 15, 2018).
Iversen, P.L., Structure Activity Study of Clinically Observed Adverse Events and Oligomer Chemistry, J. Drug Discov. Develop Deliv., 3(2):1-8 (2016).
Iwamoto, N. et al., Control of phosphorothioate stereochemistry substantially increases the efficacy of antisense oligonucleotides, Nature Biotechnol, 35(9): 845-851 (2017), with Supplemental Data, 14 pages.
Iwamoto, N. et al., Control of phosphorothioate stereochemistry substantially increases the efficacy of antisense oligonucleotides, Nature Biotechnology, 1-7 pages (2017). All Supplemental Data, 8-53 pages (2017).
Iwamoto, N. et al., Optimization of Therapeutic Phosphorothioate Oligonucleotides by P-Chirality Control, WAVE Life Sciences, PSJ Congress: The Pharmaceutical Society of Japan, (Mar. 25, 2015-Mar. 28, 2016).
Iwamoto, N. From Stereopurity to precision medicine: Optimizing the properties of antisense nucleic acid therapeutics. Paper presented at: BioJapan, Yokohama, Japan (Oct. 11, 2018).

(56) References Cited

OTHER PUBLICATIONS

Jirka, S.M.G et al., Evaluation of 2'-Deoxy-2'-fluoro Antisense Oligonucleotides for Exon Skipping in Duchenne Muscular Dystrophy, Citation: Molecular Therapy-Nucleic Acids 4, e265 1-8 (2015).
Kandasamy, P. et al., Control of backbone chemistry and chirality boost oligonucleotide splice switching activity, Nucleic Acids Research, 50(10):5443-5466 (2022).
Kandasamy, P. et al., From stereopurity to precision medicine: Optimizing the properties of antisense nucleic acid therapeutics. Paper presented at: the 45th International Symposium on Nucleic Acid Chemistry, Kyoto, Japan (Nov. 7-9, 2018).
Kawasaki, A et al., Uniformly Modified 2'-Deoxy-2'-fluoro Phosphorothioate Oligonucleotides as Nuclease-Resistant Antisense Compounds with High Affinity and Specificity for RNA Targets, J. Med. Chem., 36: 831-841 (1993).
Kiviniemi, A. et al., Solid-Supported 2'-O-Glycoconjugation of Oligonucleotides by Azidation and Click Reactions, Bioconjugate Chemistry, 22(6): 1249-1255 (2011).
Koch, T., LNA Therapeutics—update, Navigate the phosphorothioate diastereoisomer space, Roche pRED RNA Therapeutics Research, EuroTIDES, PostillionConventionCenter, Amsterdam, Netherlands (Nov. 6-9, 2018).
Kole, R. and Krieg, A. M., Exon skipping therapy for Duchenne muscular dystrophy, Advan. Drug Deliv. Rev., 87:104-107 (2015).
Kothari, N. et al., Preclinical studies of WVE-210201, an investigational stereopure antisense oligonucleotide for the treatment of patients with Duchenne muscular dystrophy (DMD) amenable to exon 51 skipping. Poster presented at: Parent Project Muscular Dystrophy Annual Connect Conference, Chicago, IL USA (Jun. 29-Jul. 2, 2017).
Koziolkewicz et al., Stability of Stereoregular Oligo-(nucleoside Phosphorothioate)s in Human Plasma: Diastereoselectiviy of Plasma 3'-Exonuclease, Antisense Nucl. Acid Drug Dev., 7: 43-48 (1997).
Koziolkiewicz, M. et al., Effect of P-chirality of oligo(deoxyribonucleoside phosphorothioate)s) on the activity of terminal deoxyribonucleotidyl transferase, FEBS Letters, 434(1-2): 77-82 (1998).
Kupryushkin, M et al., 'Dodecyl-modified oligodeoxyribonucleotides as platform for oligonucleotide delivery into eukaryotic cells,' 13th Annual Meeting of the Oligonucleotide Therapeutics Society, (2017), abstract 057.
Kupryushkin, M. S. Phosphoryl Guanidines: A New Type of Nucleic Acid Analogues, Acta Naturae, 6(4): 116-118 (2014).
Levina, A.S. et al., Impact of delivery method on antiviral activity of phosphodiester, phosphorothioate, and phosphoryl guanidine oligonucleotides in MDCK cells infected with H5N1 bird flu virus, Molecular Biology, 51(4): 633-638 (2017).
Leviten, M., Wave's Purity Progress, Biocentury, 1-6 (Sep. 28, 2017).
Lightfoot, H. L. and Hall, J., Target mRNA inhibition by oligonucleotide drugs in man, Nucl. Acids Res., 40(21):10585-10595 (2012).
Liu, J. et al., Modulation of Splicing by Single-Stranded Silencing RNAs, Nucleic Acid Therapeutics, 25(3): 113-120 (2015).
Mackellar, C. et al., Synthesis and physical properties of anti-HIV antisense oligonucleotides bearing terminal lipophilic groups, Nuc. Acids Res., 20(13):3411-3417 (1992).
Martin, P., A New Access to 2'-O-alkylated Ribonucleosides and Properties of 2'-O-Alkylated Oligoribonucleotides, Helv. Chim. Acta., Abstract Only, 78: 486-504 (1995).
Matsuda, A., Current status and prospects of nucleic acid drug development, Pharmacia, 51(5): 429-433 (2015).
Mohapatra, S. LCMS/hybridization ELISA approaches for bioanalysis of stereopure oligonucleotides. Paper presented at: American Association of Pharmaceutical Scientists Annual Meeting, Washington, DC USA (Nov. 4-7, 2018).
Morcos, P.A., Achieving targeted and quantifiable alteration of mRNA splicing with Morpholino oligos, Biochem. Biophys. Res. Commun., 358(2): 521-527 (2007).
Negishi, Y. et al., The Development of an Ultrasound-mediated Nucleic Acid Delivery System for treating Muscular Dystrophies, Pharm. Soc. Japan, 132(12): 1383-1388 (2012).
Ostergaard, M.E. et al., Efficient Synthesis and Biological Evaluation of 5'-GaINAc Conjugated Antisense Oligonucleotides, Bioconjugate. Chem., 26: 1452-1455 (2015).
Panzara, M. et al., Duchenne Muscular Dystrophy Advisory Board Meeting, WAVE Life Sciences, 70 pages (Mar. 3, 2017).
Panzara, M. et al., Exon 51 skipping mediated by WVE-210201, a potential disease-modifying therapy for Duchenne muscular dystrophy. Paper presented at: Muscular Dystrophy Association Scientific Conference, Arlington, VA USA (Mar. 21, 2017).
Panzara, M. et al., Exon 51 skipping mediated by WVE-210201, a potential disease-modifying therapy for Duchenne muscular dystrophy. Poster presented at: Muscular Dystrophy Association Scientific Conference, Arlington, VA., Poster 71 (Mar. 20, 2017).
Panzara, M. et al., Preclinical studies of WVE-210201, an investigational stereopure antisense oligonucleotide in development for the treatment of patients with Duchenne muscular dystrophy (DMD), J Neurol Sci., 381: 277-278, Abstract 763 (2017).
Panzara, M. et al., Preclinical studies of WVE-210201, an investigational stereopure antisense oligonucleotide in development for the treatment of patients with Duchenne muscular dystrophy (DMD). Poster presented at: the XXIII World Congress of Neurology, Kyoto, Japan, Poster 256 (Sep. 17, 2017).
Panzara, M. et al., Stereopure nucleic acid therapies in development for the treatment of genetic neurological diseases, Poster presented at: 19th Annual Meeting of the American Society of Experimental Neurotherapeutics, Rockville, MD, Poster 39 (Mar. 15, 2017).
Panzara, M. Stereopure nucleic acid therapies in development for the treatment of genetic neurological diseases, Neurotherapeutics, Abstract, 14: 821-822 (2017).
Panzara, M. Stereopure nucleic acid therapies in development for the treatment of genetic neurological diseases, Paper presented at: 19th Annual Meeting of the American Society of Experimental Neurotherapeutics, Rockville, MD USA (Mar. 15, 2017).
Panzara, M. Stereopure nucleic acid therapies in development for the treatment of genetic neurological diseases. Paper presented at: International Society for CNS Drug Development (ISCDD) Annual Meeting, Las Vegas, NV USA (Mar. 24, 2017).
Perez, B. et al., Antisense Mediated Splicing Modulation For Inherited Metabolic Diseases: Challenges for Delivery, Nucleic Acid Therapies, 24(1): 48-56 (2014).
Prakash, T.P. et al., Lipid Nanoparticles Improve Activity of Single-Stranded siRNA and Gapmer Antisense Oligonucleotides in Animals, ACS Chem. Biol., 5 pages (2013), DOI: 10.1021/cb4001316.
Prakash, T.P. et al., Synergistic effect of phosphorothioate, 50-vinylphosphonate and GalNAc modifications for enhancing activity of synthetic siRNA, Bioorg. Med. Chem. Lett., 26: 2817-2820 (2016).
Prakash, T.P. et al., Targeted delivery of antisense oligonucleotides to hepatocytes using triantennary N-acetyl galactosamine improves potency 10-fold in mice, Nucleic Acids Res., 42(13): 8796-807 (2014).
PubChem SID 381609295, Substance Record IBX8A21EH6 (Modify: May 19, 2019; Available: Mar. 17, 2019).
PubChem SID 381609359, Substance Record P9Z955DK1E (Modify: May 19, 2019; Available: Mar. 17, 2019).
Rigo, F. et al., Synthetic oligonucleotides recruit ILF2/3 to RNA transcripts to modulate splicing, Nat. Chem. Bio., 8:555-562 (2012).
Sanhueza, C.A. et al., Efficient Liver Targeting by Polyvalent Display of a Compact Ligand for the Asialoglycoprotein Receptor, J. Am. Chem. Soc., 9 pages (2016).
Shea, R. G. et al., Synthesis, hybridization properties and antiviral activity of lipid-oligodeoxynucleotide conjugates, Nuc. Acids Res., 18(13):3777-3783 (1990).
Shen, W. et al., Acute hepatotoxicity of 2' fluoro-modified 5-10-5 gapmer phosphorothioate oligonucleotides in mice correlates with intracellular protein binding and the loss of DBHS proteins, Nucl. Acids Res., 46(5):2204-2217 (2018).
Shivalila, C. et al., Cellular free uptake of optimized, stereopure antisense oligonucleotides predicts exon-skipping efficiency and dystrophin protein restoration in mice. Poster presented at: the 14th

(56) References Cited

OTHER PUBLICATIONS

Annual Meeting of the Oligonucleotide Therapeutic Society, Seattle, WA USA, (Sep. 30-Oct. 3, 2018).
Stetsenko, D.A. and Pyshnyi, D.V., Ex Siberia Semper Novi: Siberia Always Brings US Something New, Phosphoryl Guanidines: New Chemical Analogues of Nucleic Acids, Science First Hand, N2(41): 2 pages (Aug. 30, 2015). URL: https://scfh.ru/en/papers/phosphoryl-guanidines-new-chemical-analogues-of-nucleic-acids-/.
Surono, A. et al., Chimeric RNA/Ethylene Bridged Nucleic Acids Promote Dystrophin Expression in Myocytes of Duchenne Muscular Dystrophy by Inducing Skipping of the Nonsense Mutation-Encoding Econ, Human Gene Therapy, 15:749-757 (2004).
Takeshima, Y. et al., Oligonucleotides against a splicing enhancer sequence led to dystrophin production in muscle cells from a Duchenne muscular dystrophy patient, Brain & Development, 23:788-790 (2001).
U.S. Food and Drug Administration, Development of New Stereoisomeric Drugs, 8 pages (May 1, 1992). URL: http://www.fda.gov/Drugs/GuidanceComplianceRegulatoryInformation/Guidances/ucm122883.htm [Retrieved Jun. 15, 2016].
Van Deutekom, J.C.T. et al., Antisense-induced exon skipping restores dystrophin expression in DMD patient derived muscle cells, Human Molecular Genetics, 10(15):1547-1554 (2001).
Vargeese, C. et al., DMD exon 51 skipping efficiency and dystrophin protein restoration induced by WVE-210201, an investigational stereopure ASO. Poster presented at: DIA/FDA Oligonucleotide Therapeutics Conference, Bethesda, MD, Poster 3 (Oct. 25-27, 2017).
Vargeese, C. From Stereopurity to precision medicine: Optimising the properties of antisense nucleic acid therapeutics, Paper presented at: TIDES Europe: Oligonucleotide and Peptide Therapeutics, Amsterdam, The Netherlands (Nov. 7, 2018).
Vargeese, C. From Stereopurity to precision medicine: Optimizing the properties of antisense nucleic acid therapeutics, Paper presented at: Nature Conference on RNA at the Bench and Bedside, La Jolla, CA USA (Oct. 8, 2018).
Vargeese, C. Pharmacologic properties of stereopure oligonucleotides. Paper presented at: 44th International Symposium on Nucleic Acids Chemistry, Tokyo, Japan (Nov. 14-16, 2017).
Vargeese, C. Stereochemical control of antisense oligonucleotides enhances target efficacy. Paper presented at: the 14th Annual Meeting of the Oligonucleotide Therapeutic Society, Seattle, WA USA (Oct. 3, 2018).
Vergeese, C., Exploring new oligonucleotide backbone chemistries and their deployment to improve the properties of stereopure oligonucleotides, Wave Life Sciences, presented at Tides USA on Sep. 22, 2021.
Vetrini, F. et al., Aberrant splicing in the ocular albinism type 1 gene (OA1/GPR143) is corrected in vitro by morpholino antisense oligonucleotides, Hum. Mut., 27(5):420-426 (2006).
Vives, E. et al., Lipophilic pro-oligonucleotides are rapidly and efficiently internalized in HeLa cells, Nucleic Acids Research, 27(20):4071-4076 (1999).
Vlassov, V.V. et al., Transport of oligonucleotides across natural and model membranes, Biochimica et Biophysica Acta, 1197: 95-108 (1994).
Wagner, K. et al., Design of a Phase 2/3 Randomized Controlled Trial of Suvodirsen (WVE-210201) in Patients With Duchenne Muscular Dystrophy Amenable to Exon 51 Skipping I, Abstract of poster presented at the 2019 MDA Clinical & Scientific Conference, Orlando, FL, Apr. 13-17, 2019, 3 pages (Published Apr. 13, 2019).
Wagner, K. et al., Design of a Phase 2/3 Randomized Controlled Trial of Suvodirsen (WVE-210201) in Patients With Duchenne Muscular Dystrophy Amenable to Exon 51 Skipping I, Poster 40 presented at the 2019 MDA Clinical & Scientific Conference, Orlando, FL, Apr. 13-17, 2019 (Presented Apr. 16, 2019).
Wagner, K. et al., Safety and Tolerability of Suvodirsen (WVE-210201) in Patients With Duchenne Muscular Dystrophy: Results From a Phase 1 Clinical Trial, Abstract of poster presented at the 2019 MDA Clinical & Scientific Conference, Orlando, FL, Apr. 13-17, 2019, 3 pages (Published Apr. 13, 2019).
Wagner, K. et al., Safety and Tolerability of Suvodirsen (WVE-210201) in Patients With Duchenne Muscular Dystrophy: Results From a Phase 1 Clinical Trial, Poster 38 presented at the 2019 MDA Clinical & Scientific Conference, Orlando, FL, Apr. 13-17, 2019 (Presented Apr. 16, 2019).
Wan et al., Synthesis of Second Generation Antisense Oligonucleotides Containing Chiral Phosphorothioate Linkages and Evaluation of their Biophysical Properties and Biological Activity, 10th Annual Meeting of the Oligonucleotide Therapeutics Society, abstract received by Applicant Oct. 7, 2014, poster setup prior to presentation (first known to Applicant late Oct. 12, 2014, PST), poster presentation Oct. 13, 2014.
Wan, W.B. and Seth, P.P., The Medicinal Chemistry of Therapeutic Oligonucleotides, J. Med. Chem., 59: 9645-9667 (2016).
Wan, W.B. et al., Synthesis, biophysical properties and biological activity of second generation antisense oligonucleotides containing chiral phosphorothioate linkages, Nucleic Acid Research, 42: 13456-13468 (2014). Supplementary Information, 14 pages.
WAVE Life Sciences Press Release, WAVE Life Sciences Announces Discontinuation of Suvodirsen Development for Duchenne Muscular Dystrophy, 2 pages (Dec. 16, 2019).
WAVE Life Sciences Press Release, WAVE Life Sciences Announces Plan to Deliver Six Clinical Programs by 2018, 6 pages (Jan. 29, 2016).
WAVE Life Sciences Press Release, WAVE Life Sciences Reports First Quarter 2016 Financial Results and Provides Business Update, 9 pages (May 16, 2016).
WAVE Life Sciences Press Release, WAVE Life Sciences Reports Second Quarter 2016 Financial Results and Provides Business Update, 10 pages (Aug. 15, 2016).
WAVE Life Sciences Press Release, WAVE Life Sciences to Advance Next-Generation Nucleic Acid Therapies to Address Unmet Need in Duchenne Muscular Dystrophy, 6 pages (May 9, 2016).
WAVE Life Sciences, Second Quarter 2022 Earnings Presentation, 27 pages, (2022).
WAVE Life Sciences, Third Quarter 2022 Earnings Presentation, 24 pages, (2022).
WAVE Life Sciences, WAVE Life Sciences Corporate Presentation, 63 pages, May 12, 2022.
Wood, M. et al., Preclinical studies of WVE-210201, an investigational stereopure antisense oligonucleotide for the treatment of patients with Duchenne muscular dystrophy amenable to exon 51 skipping. Poster presented at: 13th Annual Meeting of the Oligonucleotide Therapeutics Society, Bordeaux, France, Poster 127 (Sep. 24-27, 2017).
Wood, M. et al., WVE-210201, an investigational stereopure oligonucleotide therapy for Duchenne muscular dystrophy, induces exon 51 skipping and dystrophin protein restoration, Neuromuscul Disord., 27: S217, Abstract P402 (2017).
Wood, M. et al., WVE-210201, an investigational stereopure oligonucleotide therapy for Duchenne muscular dystrophy, induces exon 51 skipping and dystrophin protein restoration. Poster presented at: 22nd International Congress of the World Muscle Society, Saint Malo, France, Poster p. 402 (Oct. 5, 2017).
Written Opinion for PCT/US2016/056123, 15 pages (Mar. 17, 2017).
Written Opinion for PCT/US2017/030777, 10 pages (Oct. 2, 2017).
Written Opinion for PCT/US2017/055601, ISR/US, 16 pages (mailed Feb. 15, 2018).
Xiong, H.Y. et al., The human splicing code reveals new insights into the genetic determinants of disease, Science, 347(6218): 144 1254806-1-1254806-8 (2015).
Yuasa, K. et al., Gene therapy of muscular dystrophy: systemic gene delivery to skeletal muscles, Drug Deliv. Sys., 22(2):140-147 (2007).
Zhang, J. et al., Investigational exon-skipping stereopure oligonucleotides in Duchenne muscular dystrophy, Poster presented at: The Action Duchenne International Conference, Birmingham, UK (Nov. 9-11, 2018).
Zhang, J. et al., Investigational exon-skipping stereopure oligonucleotides in Duchenne muscular dystrophy. Poster presented at: CureDuchenne Futures, Needham, MA USA (Nov. 3-4, 2018).

(56) References Cited

OTHER PUBLICATIONS

Zhang, J. et al., Optimization of Exon Skipping Therapies for Duchenne Muscular Dystrophy, WAVE Life Sciences, PPMD: Parent Project Muscular Dystrophy Meeting, Orlando, FL, Poster, 1 page (Jul. 25, 2016).
Zhang, J. et al., Optimization of exon skipping therapies for Duchenne muscular dystrophy. Poster presented at: Parent Project Muscular Dystrophy's (PPMD) Annual Connect Conference, Orlando, FL USA (Jun. 26, 2016).
Zhang, J. et al., Potency, stability, and immune system effects of WVE-210201, an investigational stereopure oligonucleotide for the treatment of Duchenne muscular dystrophy. Poster presented at: Action Duchenne 16th International Conference, Birmingham, UK (Nov. 9-11, 2017).
Zhang, J. et al., Stereopure oligonucleotides: exon-skipping efficiency and dystrophin restoration in mdx23 mice, Poster presented at: The Action Duchenne International Conference, Birmingham, UK (Nov. 9-11, 2018).
Zhang, J. et al., Stereopure oligonucleotides: exon-skipping efficiency and dystrophin restoration in mdx23 mice. Poster presented at: CureDuchenne Futures, Needham, MA USA (Nov. 3-4, 2018).
Zhang, Y. et al., Structural Isosteres of Phosphate Groups in the Protein Data Bank, J. Chem. Inf. Model, 1-18 (2017).
Zhang, Y., Investigating phosphate structural replacements through computational and experimental approaches, Academic Dissertain, University of Helsinki, 119 pages (2014).
Zhong, Z. et al., WAVE Life Sciences: Developing Stereopure Nucleic Acid Therapies for the Treatment of Genetic Neurological Diseases, World CNS Summit 2017, Boston, MA, Wave Life Sciences, Poster, 1 page (Feb. 20-22, 2017).
Zhong, Z. Stereochemical control of antisense oligonucleotides enhances target efficacy. Paper presented at: TIDES: Oligonucleotide and Peptide Therapeutics, Boston, MA USA (May 9, 2018).
Zhong, Z. Wave Life Sciences: Developing stereopure nucleic acid therapies for the treatment of serious genetically defined diseases, Paper presented at: ALS Drug Discovery Roundtable Meeting, Boston, MA (Apr. 25, 2017).
U.S. Appl. No. 18/178,470, filed Mar. 3, 2023, Vargeese et al.
U.S. Appl. No. 18/185,901, filed Mar. 17, 2023, Bowman et al.
U.S. Appl. No. 18/204,895, filed Jun. 1, 2023, Vargeese et al.
U.S. Appl. No. 18/252,029, filed May 5, 2023, Monian et al.
U.S. Appl. No. 18/305,195, filed Apr. 21, 2023, Frank-Kamenetsky et al.
U.S. Appl. No. 18/316,932, filed May 12, 2023, Butler et al.
WAVE Life Sciences, WAVE Life Sciences Corporate Presentation, 32 pages, Aug. 3, 2023.
WAVE Life Sciences, R&D Day Presentation, 81 pages (Sep. 28, 2023).
U.S. Appl. No. 18/522,146, filed Nov. 28, 2023, Butler et al.
U.S. Appl. No. 18/613,034, filed Mar. 21, 2024, Vargeese et al.
U.S. Appl. No. 18/695,346, filed Mar. 25, 2024, Monian et al.
U.S. Appl. No. 18/695,348, filed Mar. 25, 2024, Acker et al.
WAVE Life Sciences, WAVE Life Sciences Corporate Presentation, 42nd Annual J.P. Morgan Healthcare Conference, 27 pages, Jan. 10, 2024.
U.S. Appl. No. 18/704,629, filed Apr. 25, 2024, Byrne et al.
U.S. Appl. No. 18/836,993, filed Aug. 8, 2024, Kandasamy et al.
U.S. Appl. No. 18/843,171, filed Aug. 30, 2024, Hu et al.
U.S. Appl. No. 18/856,553, filed Oct. 11, 2024, Lu et al.
U.S. Appl. No. 18/864,860, filed Nov. 11, 2024, Shivalila et al.
U.S. Appl. No. 18/864,863, filed Nov. 11, 2024, Liu et al.
U.S. Appl. No. 18/942,334, filed Nov. 8, 2024, Yang et al.
Chen, S. et al., Systematic evaluation of 2'-Fluoro modified chimeric antisense oligonucleotide-mediated exon skipping in vitro, Sci. Repo., 9(6078):1-10 (2019).
Shen, W. et al., 2'-Fluoro-modified phosphorothioate oligonucleotide can cause rapid degradation of P54nrb and PSF, Nuc. Acids Res., 43(9):4569-4578 (2015).
U.S. Appl. No. 18/953,020, filed Nov. 19, 2024, Meena et al.
U.S. Appl. No. 19/008,522, filed Jan. 2, 2025, Vargeese et al.
U.S. Appl. No. 19/085,460, filed Mar. 20, 2025, Bowman et al.
U.S. Appl. No. 19/102,669, filed Feb. 10, 2025, Lake et al.
U.S. Appl. No. 19/217,825, filed May 23, 2025, Vargeese et al.
U.S. Appl. No. 19/241,178, filed Jun. 17, 2025, Zhang et al.
WAVE Life Sciences Press Release, WAVE Life Sciences Announces Positive Data from FORWARD-53 Clinical Trial in DMD Including Significant Functional Benefit and Reversal of Muscle Damage after 48 Weeks of Dosing with WVE-N531, 3 pages (Mar. 26, 2025).
WAVE Life Sciences, 48-Week Results from FORWARD-53 Trial of WVE-N531 in Duchenne Muscular Dystrophy, Investor Presentation, 38 pages, Mar. 26, 2025.

FIG. 7A

| | | |
|---|---|---|
| | WV395.02 | mU*SmC*SmA*SmA*SmG*SmG*SmA*SmA*SmG*SmA*SmU*SmG*SmG*SmC*SmA*SmU*SmU*SmU*SmC*SmU |
| | WV884.01 | mU*RmC*RmA*RmA*RmG*RmG*RmA*RmA*RmG*RmA*RmU*RmG*RmG*RmC*RmA*RmU*RmU*RmU*RmC*RmU |
| | WV885.01 | mU*SmC*RmA*SmA*RmG*SmG*RmA*SmA*RmG*SmA*RmU*SmG*RmG*SmC*RmA*SmU*RmU*SmU*RmC*SmU |
| | WV886.01 | mU*RmC*RmA*RmA*SmG*SmG*SmA*SmA*SmG*SmA*SmU*SmG*SmG*SmC*SmA*SmU*SmU*RmU*RmC*RmU |
| | WV887.01 | mU*SmC*SmA*SmA*RmG*RmG*RmA*RmA*RmG*RmA*RmU*RmG*RmG*RmC*RmA*RmU*RmU*SmU*SmC*SmU |
| | WV888.02 | mU*RmC*RmA*RmA*RmG*RmG*SmA*SmA*RmG*SmA*SmU*RmG*SmG*SmC*RmA*RmU*RmU*RmU*RmC*RmU |
| | WV889.01 | mU*SmC*SmA*SmA*SmG*SmG*RmA*RmA*SmG*RmA*RmU*SmG*RmG*RmC*SmA*SmU*SmU*SmU*SmC*SmU |
| | WV890.01 | mU*RmC*RmA*RmA*SmG*SmG*RmA*RmA*SmG*RmA*RmU*RmG*SmG*RmC*RmA*SmU*SmU*RmU*RmC*RmU |
| | WV891.01 | mU*SmC*SmA*SmA*RmG*RmG*SmA*SmA*RmG*SmA*SmU*SmG*RmG*SmC*SmA*RmU*RmU*SmU*SmC*SmU |
| | WV892.01 | mU*SmC*RmA*RmA*RmG*RmG*RmA*RmA*RmG*RmA*RmU*RmG*RmG*RmC*RmA*RmU*RmU*RmU*RmC*SmU |
| | WV893.01 | mU*RmC*SmA*SmA*SmG*SmG*SmA*SmA*SmG*SmA*SmU*SmG*SmG*SmC*SmA*SmU*SmU*SmU*SmC*RmU |
| | WV894.01 | mU*SmC*RmA*SmA*SmG*RmG*RmA*SmA*SmG*RmA*SmU*SmG*RmG*RmC*RmA*SmU*SmU*SmU*SmC*RmU |
| | WV895.01 | mU*RmC*SmA*RmA*RmG*SmG*SmA*RmA*RmG*SmA*RmU*RmG*SmG*SmC*SmA*RmU*RmU*RmU*RmC*SmU |
| | WV896.01 | mU*SmC*SmA*RmA*RmG*RmG*RmA*RmA*RmG*RmA*RmU*SmG*RmG*RmC*SmA*RmU*SmU*SmU*SmC*SmU |
| | WV897.01 | mU*RmC*RmA*SmA*SmG*SmG*SmA*SmA*SmG*SmA*SmU*RmG*SmG*SmC*RmA*SmU*RmU*RmU*RmC*RmU |

FIG. 9A

| | | |
|---|---|---|
| Different # of 2'F | WV-2095 | fU*fC*fA*fA*fG*mG*mA*mA*mG*mA*mU*mG*mG*mC*mA*fU*fU*fU*fC*fU |
| | WV-2096 | fU*fC*fA*fA*mG*mG*mA*mA*mG*mA*mU*mG*mG*mC*mA*mU*fU*fU*fC*fU |
| | WV-2097 | fU*fC*fA*mA*mG*mG*mA*mA*mG*mA*mU*mG*mG*mC*mA*mU*mU*fU*fC*fU |
| | WV-2098 | fU*fC*mA*mA*mG*mG*mA*mA*mG*mA*mU*mG*mG*mC*mA*mU*mU*mU*fC*fU |
| | WV-2099 | fU*mC*mA*mA*mG*mG*mA*mA*mG*mA*mU*mG*mG*mC*mA*mU*mU*mU*mC*fU |
| | | |
| Different # of PS for 2'F | WV-2100 | fU*fC*fA*fA*fG*fGmA*mA*mG*mA*mU*mG*mG*mCfA*fU*fU*fU*fC*fU |
| | WV-2101 | fU*fC*fA*fA*fGfGmA*mA*mG*mA*mU*mG*mG*mCfAfU*fU*fU*fC*fU |
| | WV-2102 | fU*fC*fA*fAfGfGmA*mA*mG*mA*mU*mG*mG*mCfAfUfU*fU*fC*fU |
| | WV-2103 | fU*fC*fAfAfGfGmA*mA*mG*mA*mU*mG*mG*mCfAfUfUfU*fC*fU |
| | WV-2104 | fU*fCfAfAfGfGmA*mA*mG*mA*mU*mG*mG*mCfAfUfUfUfC*fU |
| | WV-2105 | fUfCfAfAfGfGmA*mA*mG*mA*mU*mG*mG*mCfAfUfUfUfCfU |
| | | |
| Hemimers | WV-2106 | fU*fC*fA*fA*fG*fG*fA*fA*fG*fA*mU*mG*mG*mC*mA*mU*mU*mU*mC*mU |
| | WV-2107 | mU*mC*mA*mA*mG*mG*mA*mA*mG*mA*fU*fG*fG*fC*fA*fU*fU*fU*fC*fU |
| | WV-2108 | fU*fC*fA*fA*fG*fG*mA*mA*mG*mA*mU*mG*mG*mC*mA*mU*mU*mU*mC*mU |
| | WV-2109 | mU*mC*mA*mA*mG*mG*mA*mA*mG*mA*mU*mG*mG*mC*fA*fU*fU*fU*fC*fU |

Taqman

Taqman

FIG. 11A

| | | |
|---|---|---|
| | WV-1108 | mUmCmAmAmGmGmAmAmGmAmUmGmGmCmAmUmUmUmCmU |
| | WV-2381 | mU*mCmAmAmGmGmAmAmGmAmUmGmGmCmAmUmUmUmC*mU |
| | WV-2382 | mU*mC*mAmAmGmGmAmAmGmAmUmGmGmCmAmUmUmU*mC*mU |
| | WV-2383 | mU*mC*mA*mAmGmGmAmAmGmAmUmGmGmCmAmUmU*mU*mC*mU |
| | WV-2384 | mU*mC*mA*mA*mGmGmAmAmGmAmUmGmGmCmAmU*mU*mU*mC*mU |
| | WV-2385 | mU*mC*mA*mA*mG*mGmAmAmGmAmUmGmGmCmA*mU*mU*mU*mC*mU |

Taqman

FIG. 13A

| | | |
|---|---|---|
| | WV-2366 | mU*SmCmAmAmGmGmAmAmGmAmUmGmGmCmAmUmUmUmC*SmU |
| | WV-2367 | mU*SmC*SmAmAmGmGmAmAmGmAmUmGmGmCmAmUmUmU*SmC*SmU |
| | WV-2368 | mU*SmC*SmA*SmAmGmGmAmAmGmAmUmGmGmCmAmUmU*SmU*SmC*SmU |
| | WV-2369 | mU*SmC*SmA*SmA*SmGmGmAmAmGmAmUmGmGmCmAmU*SmU*SmU*SmC*SmU |
| | WV-2370 | mU*SmC*SmA*SmA*SmG*SmGmAmAmGmAmUmGmGmCmA*SmU*SmU*SmU*SmC*SmU |

FIG. 15

| | |
|---|---|
| WV-2223 | mC*mA*mA* mG*mG*mA* mA*mG*mA* mU*mG*mG* mC*mA*mU* mU*mU*mC* mU*mA*mG* mU*mU*mU* mG |
| WV-2224 | mC*mA*mU* mC*mA*mA* mG*mG*mA* mA*mG*mA* mU*mG*mG* mC*mA*mU* mU*mU*mC* mU*mA*mG* mU |
| WV-2225 | mA*mC*mA* mU*mC*mA* mA*mG*mG* mA*mA*mG* mA*mU*mG* mG*mC*mA* mU*mU*mU* mC*mU*mA* mG |
| WV-2226 | mA*mA*mC* mA*mU*mC* mA*mA*mG* mG*mA*mA* mG*mA*mU* mG*mG*mC* mA*mU*mU* mU*mC*mU* mA |
| WV-2227 | mC*mA*mA* mC*mA*mU* mC*mA*mA* mG*mG*mA* mA*mG*mA* mU*mG*mG* mC*mA*mU* mU*mU*mC* mU |
| WV-2228 | mC*mU*mC* mC*mA*mA* mC*mA*mU* mC*mA*mA* mG*mG*mA* mA*mG*mA* mU*mG*mG* mC*mA*mU* mU |
| WV-2229 | mA*mC*mC* mU*mC*mC* mA*mA*mC* mA*mU*mC* mA*mA*mG* mG*mA*mA* mG*mA*mU* mG*mG*mC* mA |
| WV-2230 | mG*mU*mA* mC*mC*mU* mC*mC*mA* mA*mC*mA* mU*mC*mA* mA*mG*mG* mA*mA*mG* mA*mU*mG* mG |
| | |
| WV-2313 | mA*mU*mU* mU*mC*mU* mA*mG*mU* mU*mU*mG* mG*mA*mG* mA*mU*mG* mG*mC |
| WV-2314 | mU*mG*mG* mC*mA*mU* mU*mU*mC* mU*mA*mG* mU*mU*mU* mG*mG*mA* mG*mA |
| WV-2315 | mG*mA*mU* mG*mG*mC* mA*mU*mU* mU*mC*mU* mA*mG*mU* mU*mU*mG* mG*mA |
| WV-2316 | mA*mG*mA* mU*mG*mG* mC*mA*mU* mU*mU*mC* mU*mA*mG* mU*mU*mU* mG*mG |
| WV-2317 | mA*mA*mG* mA*mU*mG* mG*mC*mA* mU*mU*mU* mC*mU*mA* mG*mU*mU* mU*mG |
| WV-2318 | mA*mG*mG* mA*mA*mG* mA*mU*mG* mG*mC*mA* mU*mU*mU* mC*mU*mA* mG*mU |
| WV-2319 | mA*mA*mG* mG*mA*mA* mG*mA*mU* mG*mG*mC* mA*mU*mU* mU*mC*mU* mA*mG |
| WV-2320 | mC*mA*mA* mG*mG*mA* mA*mG*mA* mU*mG*mG* mC*mA*mU* mU*mU*mC* mU*mA |

| Oligo (WaVe #) | Conjugated Acid | Carbon | double bond |
|---|---|---|---|
| WV-2578 | Lauric acid | 12 | 0 |
| WV-2579 | Myristic Acid | 14 | 0 |
| WV-2580 | Palmitic acid | 16 | 0 |
| WV-2581 | Stearic acid | 18 | 0 |
| WV-2582 | Oleic acid | 18 | 1 |
| WV-2583 | Linoleic acid | 18 | 2 |
| WV-2584 | a-Linolenic acid | 18 | 3 |
| WV-2585 | g-Linolenic acid | 18 | 3 |
| WV-2586 | cis-DHA | 22 | 6 |
| WV-2587 | Turbinaric acid | 27 | 5 |
| WV-2588 | Dilinoleyl | 37 | 4 |

| Oligo (WaVe #) | Conjugated Acid | Carbon | double bond |
|---|---|---|---|
| WV-2578 | Lauric acid | 12 | 0 |
| WV-2579 | Myristic Acid | 14 | 0 |
| WV-2580 | Palmitic acid | 16 | 0 |
| WV-2581 | Stearic acid | 18 | 0 |
| WV-2582 | Oleic acid | 18 | 1 |
| WV-2583 | Linoleic acid | 18 | 2 |
| WV-2584 | a-Linolenic acid | 18 | 3 |
| WV-2585 | g-Linolenic acid | 18 | 3 |
| WV-2586 | cis-DHA | 22 | 6 |
| WV-2587 | Turbinaric acid | 27 | 5 |
| WV-2588 | Dilinoleyl | 37 | 4 |

Heart

Gastrocnemius

FIG. 27A.
WV887.02
UPLC(RP) analysis
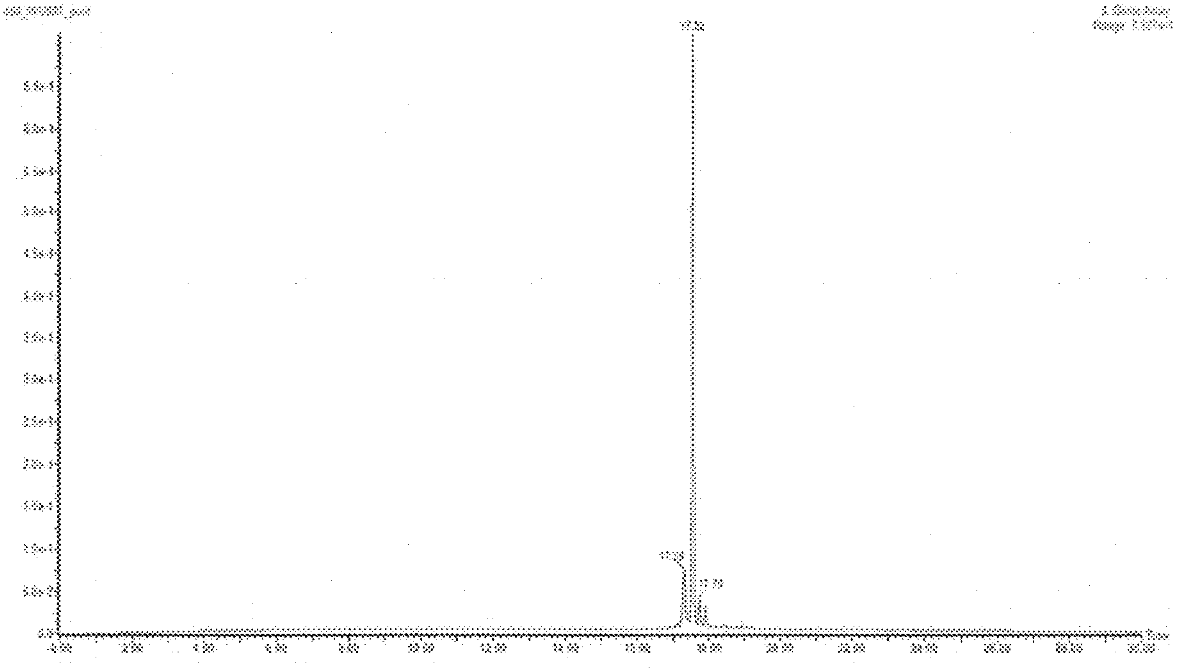
UPLC-MS analysis [MW]: calcd 6977.61, found 6977.5
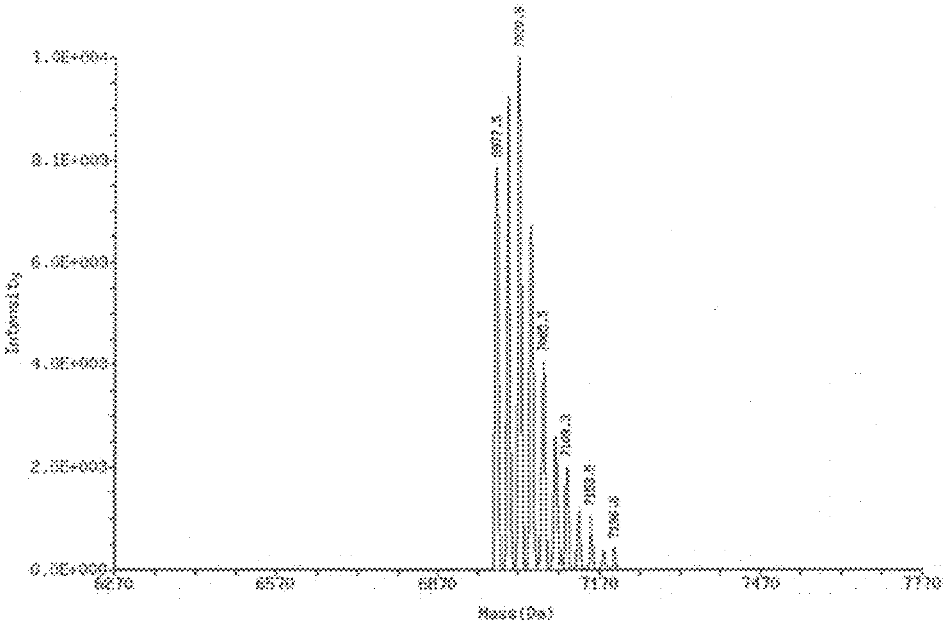
WV887.02

FIG. 27B.
UPLC(RP) analysis
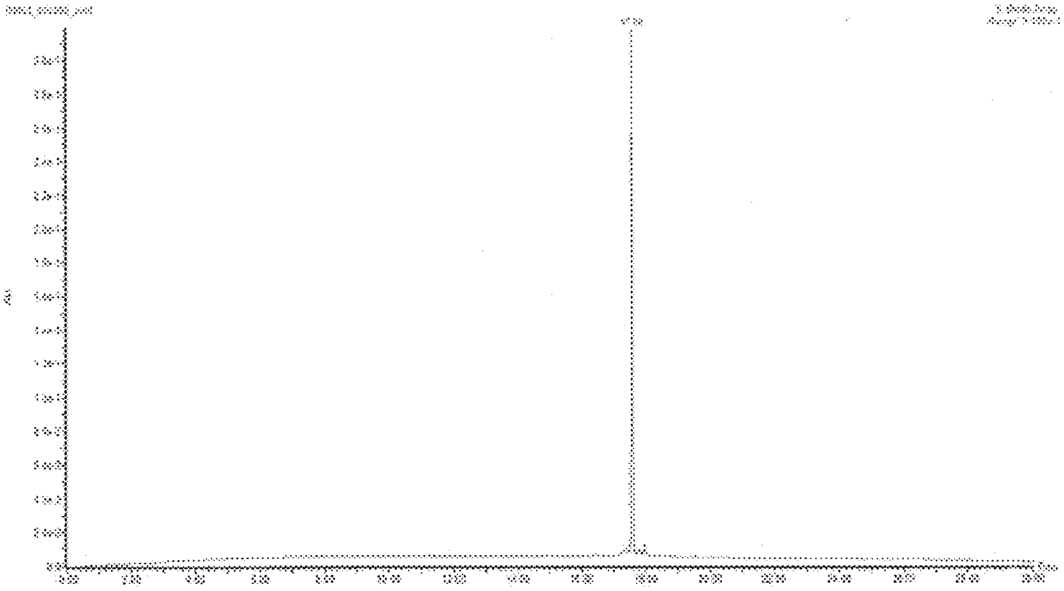
WV892.02
UPLC-MS analysis [MW]: calcd 6977.81, found 6978.8
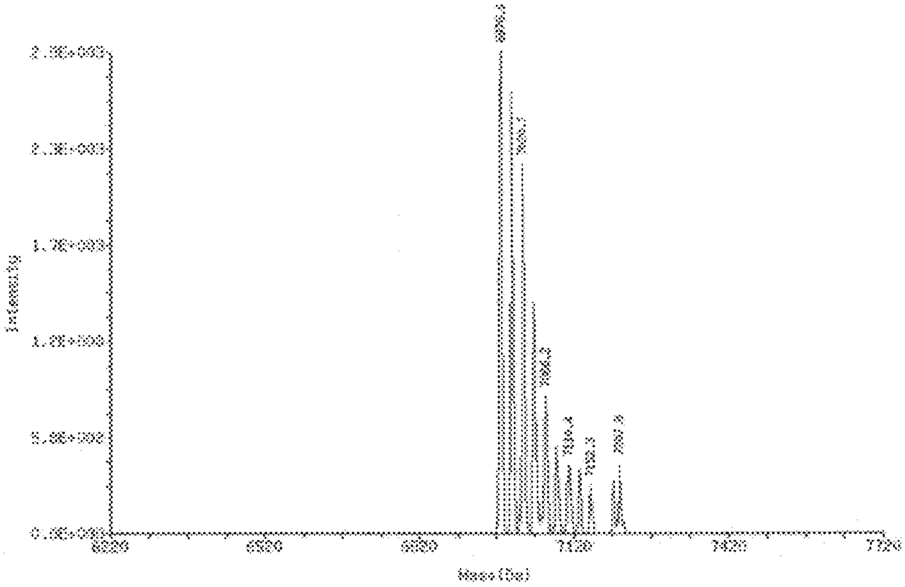
WV892.02

FIG. 27C.
UPLC(RP) Analysis
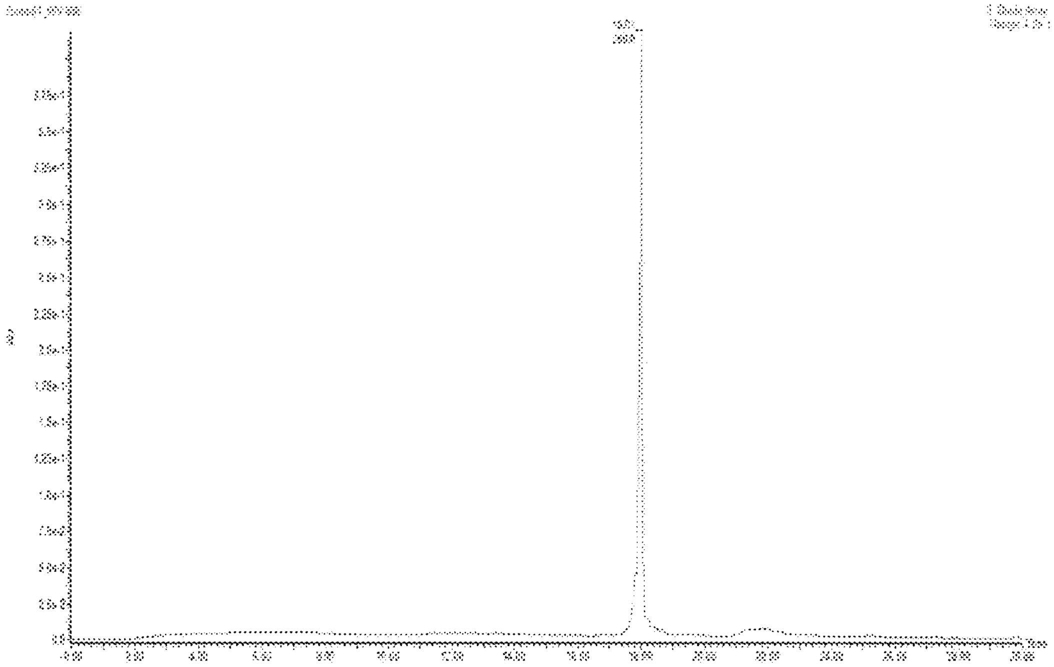
WV896.01
UPLC-MS Analysis [M-H]⁻: calcd 6976.61, found 6976.5
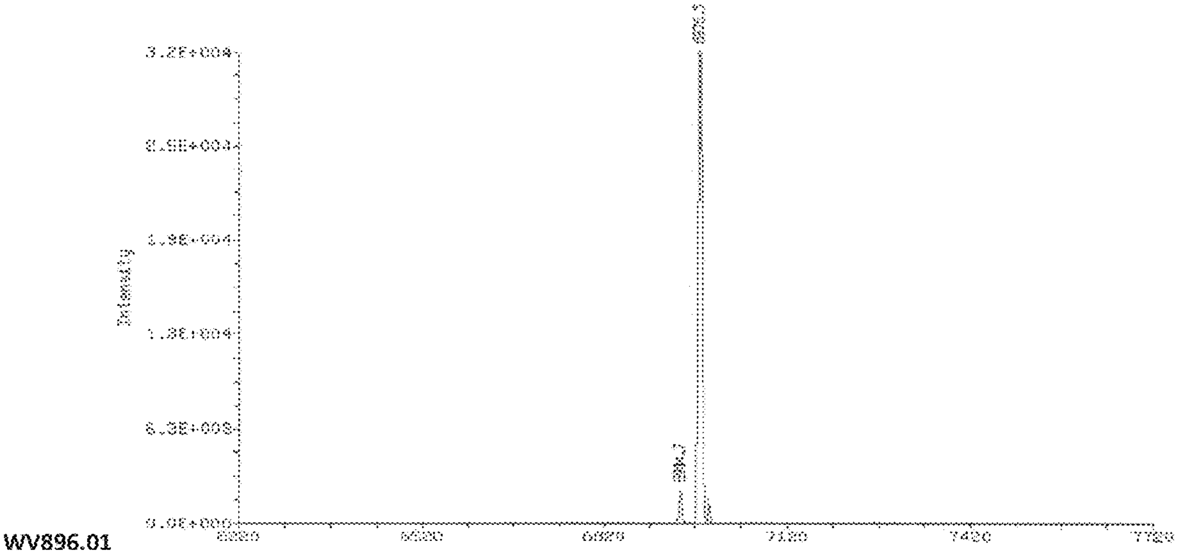
WV896.01

FIG. 27D.
UPLC(RP) analysis
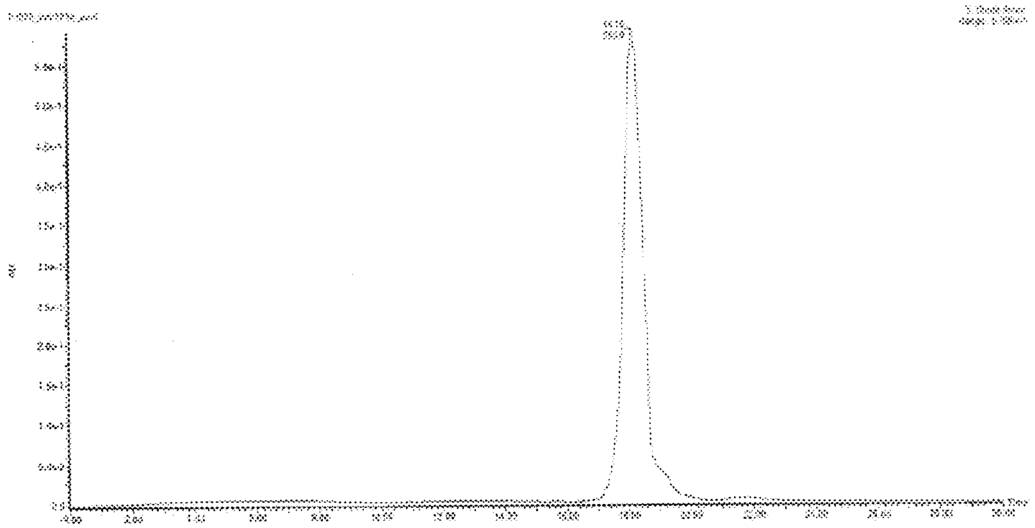
WV1714.01
UPLC-MS analysis [MW]: calcd 6833.19, found 6827.9
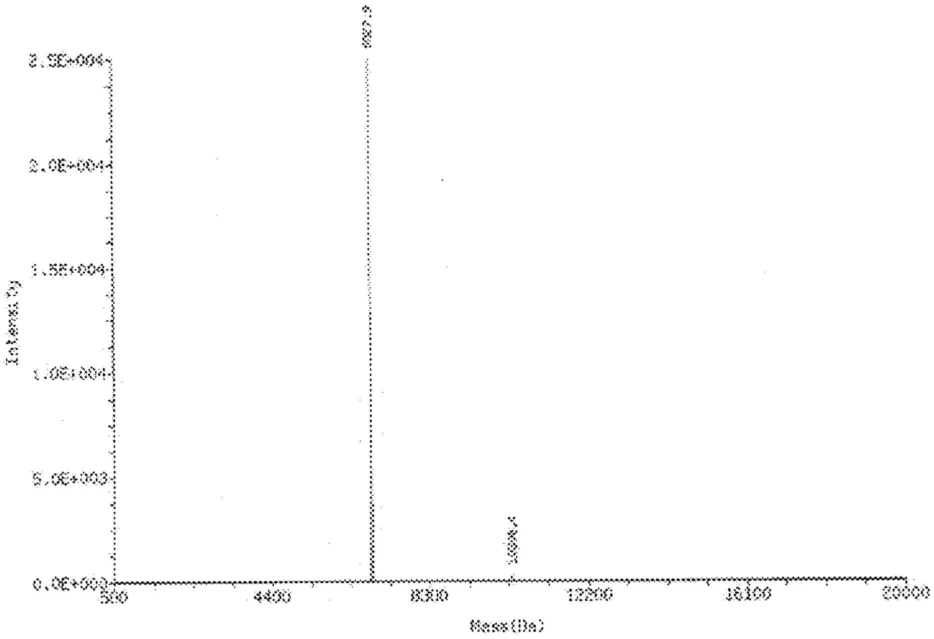
WV1714.01

FIG. 27E.
UPLC(RP) analysis
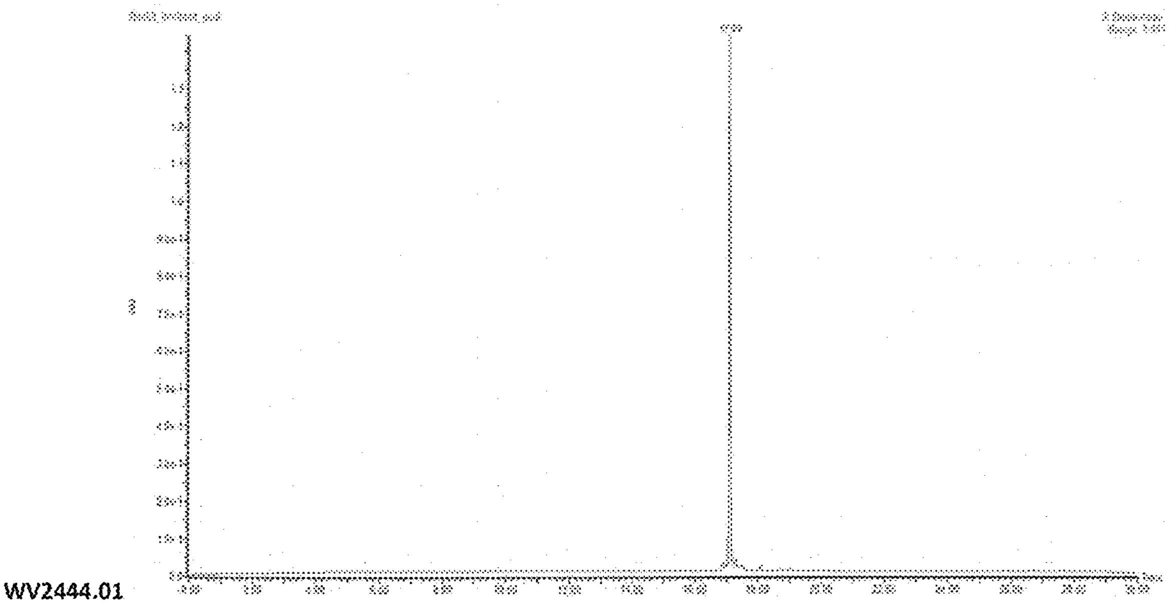
WV2444.01
UPLC-MS analysis [MW]: calcd 6833.18, found 6832.8
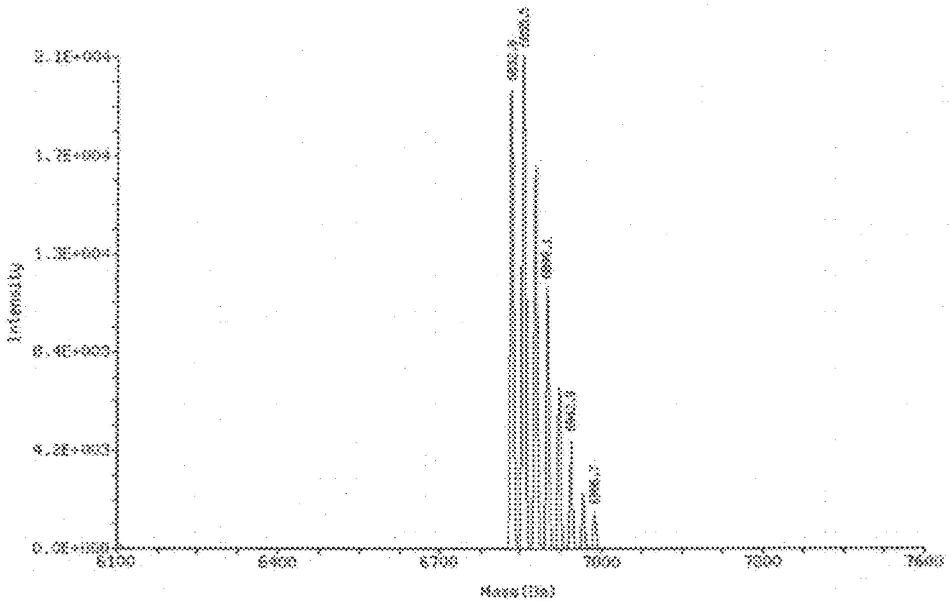
WV2444.01

FIG. 27F.
UPLC(RP) analysis
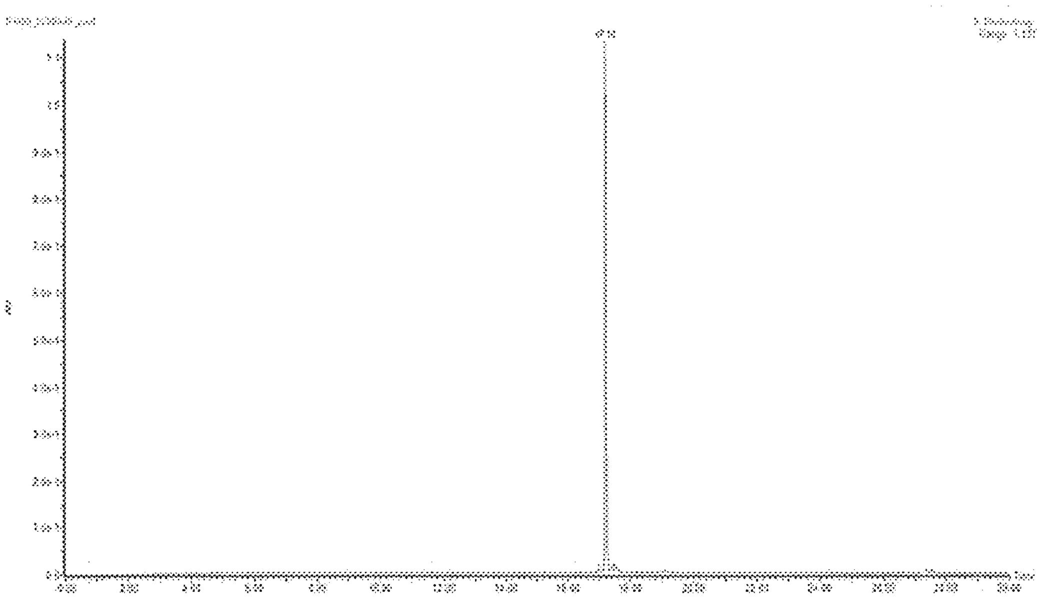
WV2445.01
UPLC-MS analysis [MW]: calcd 6857.26, found 6857.6
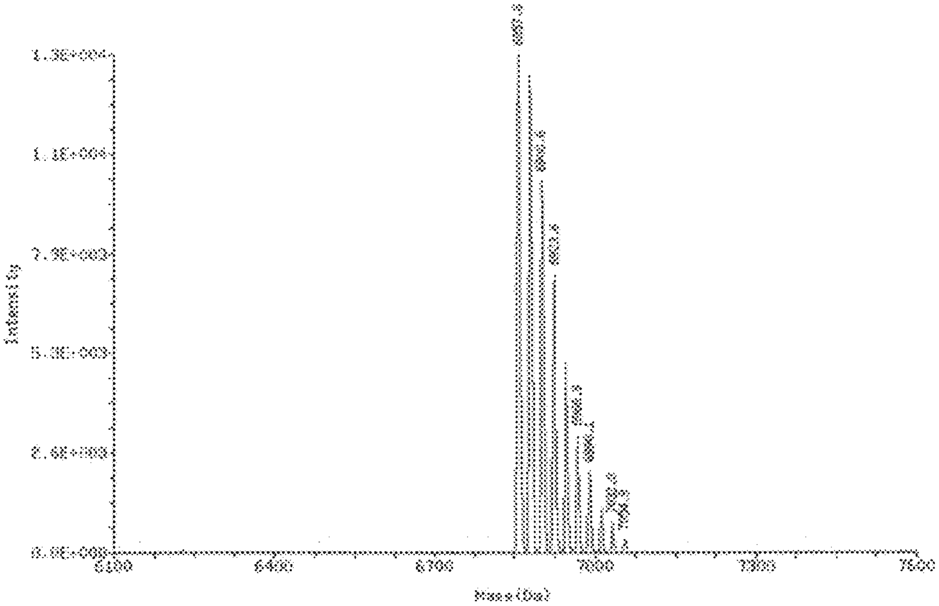
WV2445.01

WV2526.01

FIG. 27H.
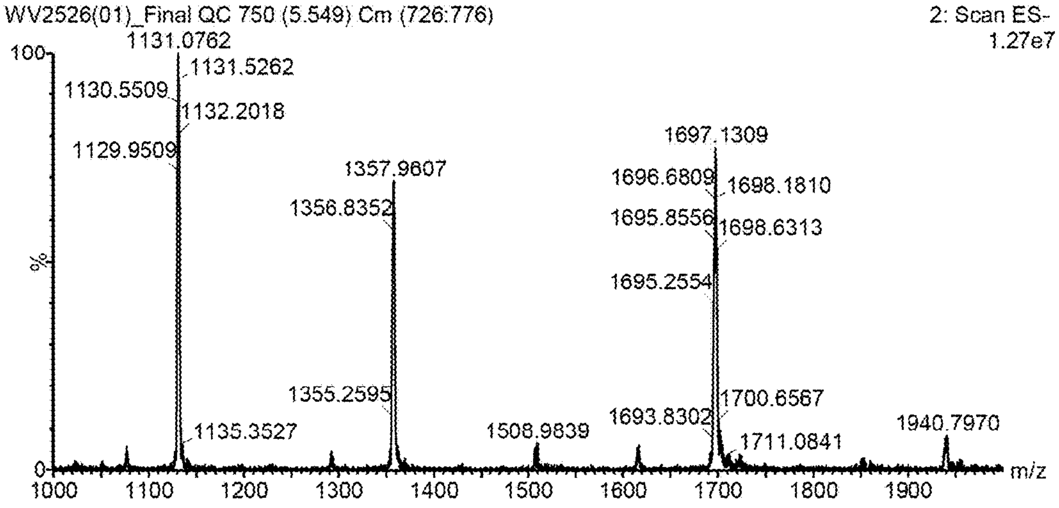
WV2526.01
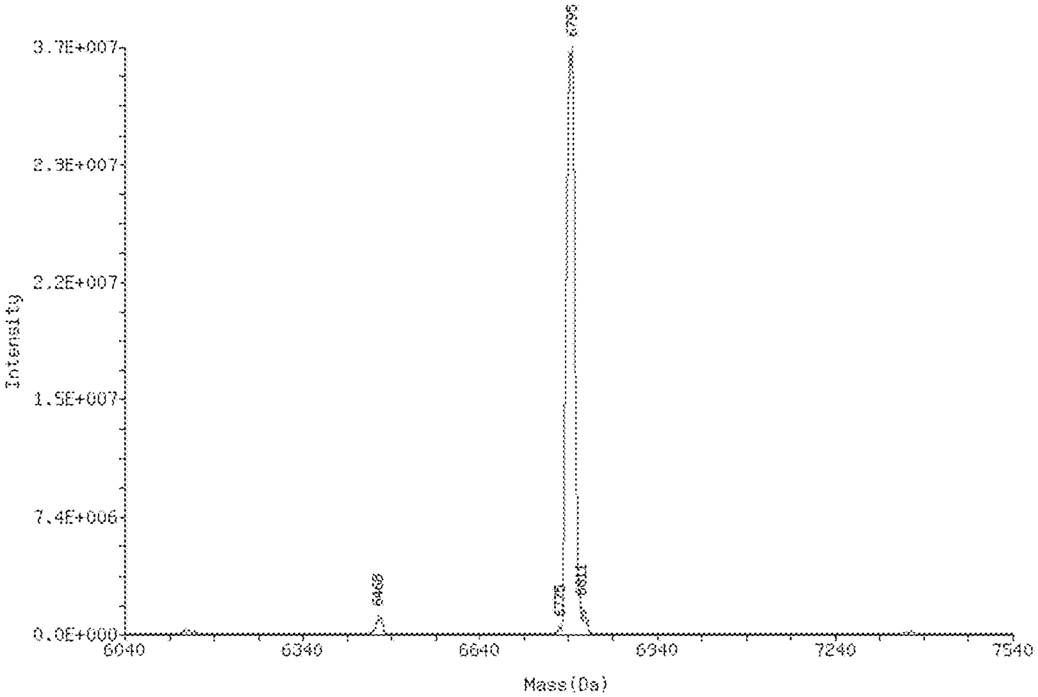
WV2526.01

WV2527.01

FIG. 27J.
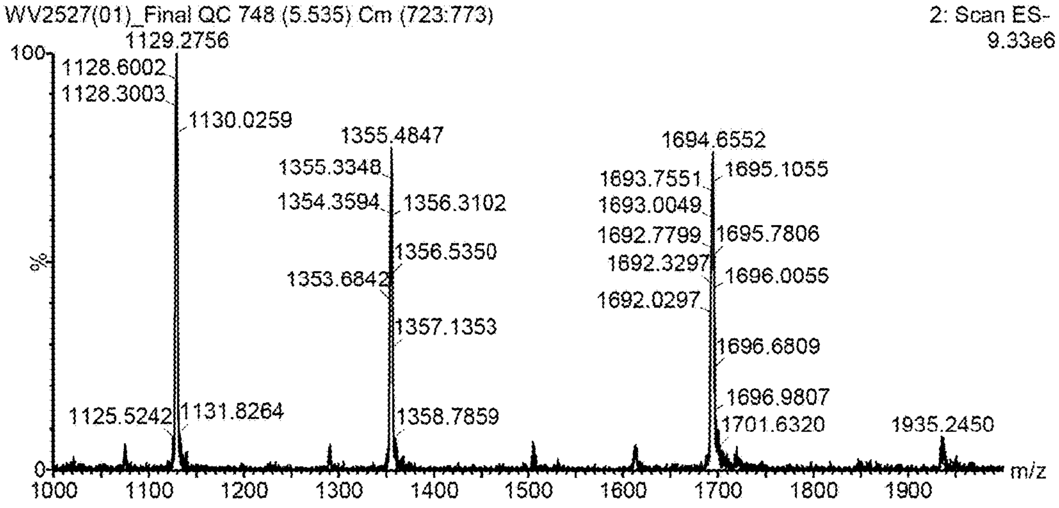
WV2527.01
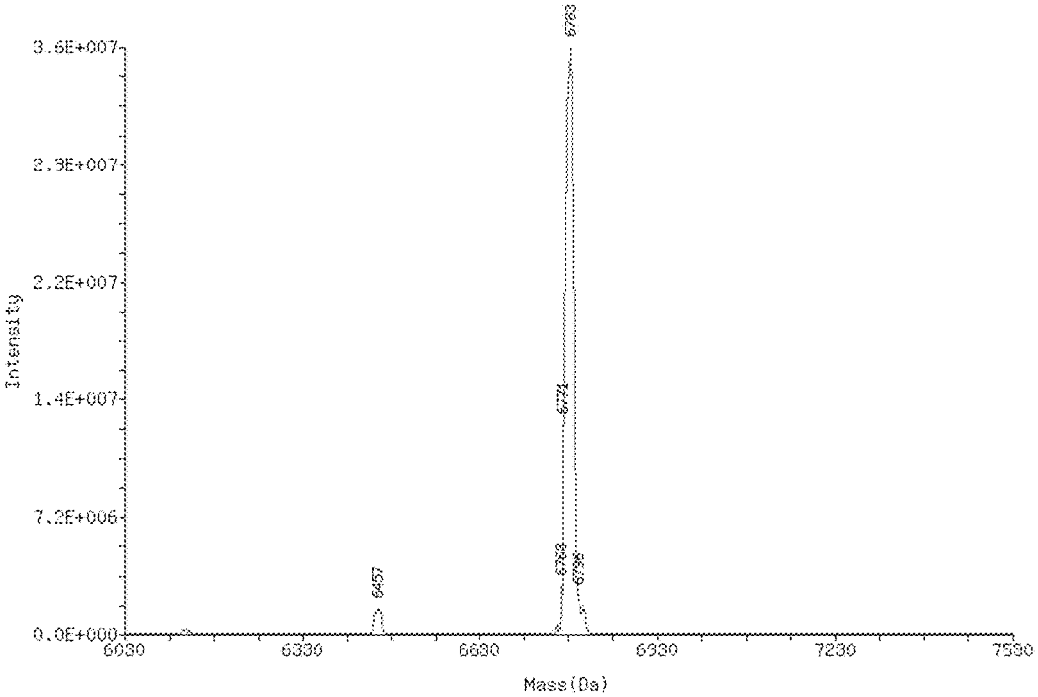
WV2527.01

WV2528.01

FIG. 27L.
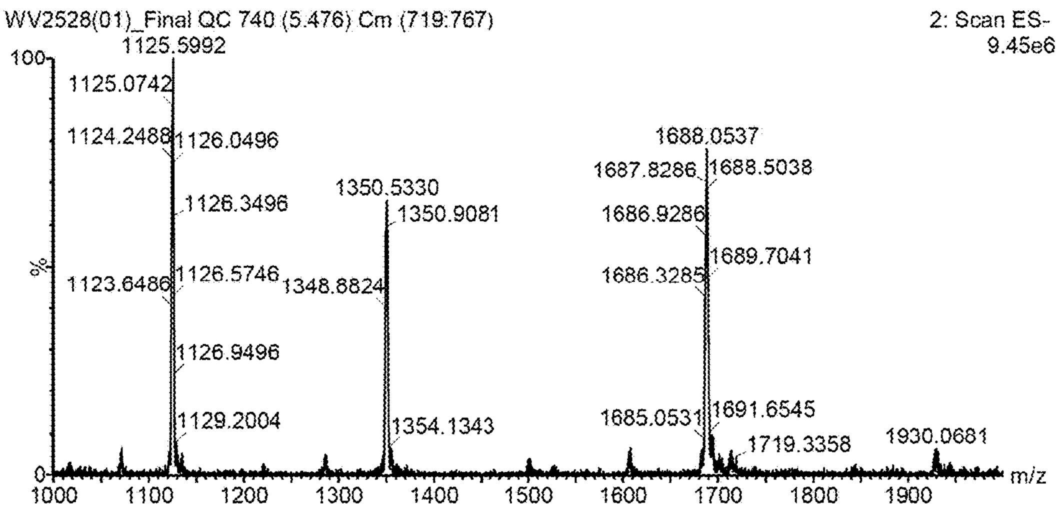
WV2528.01
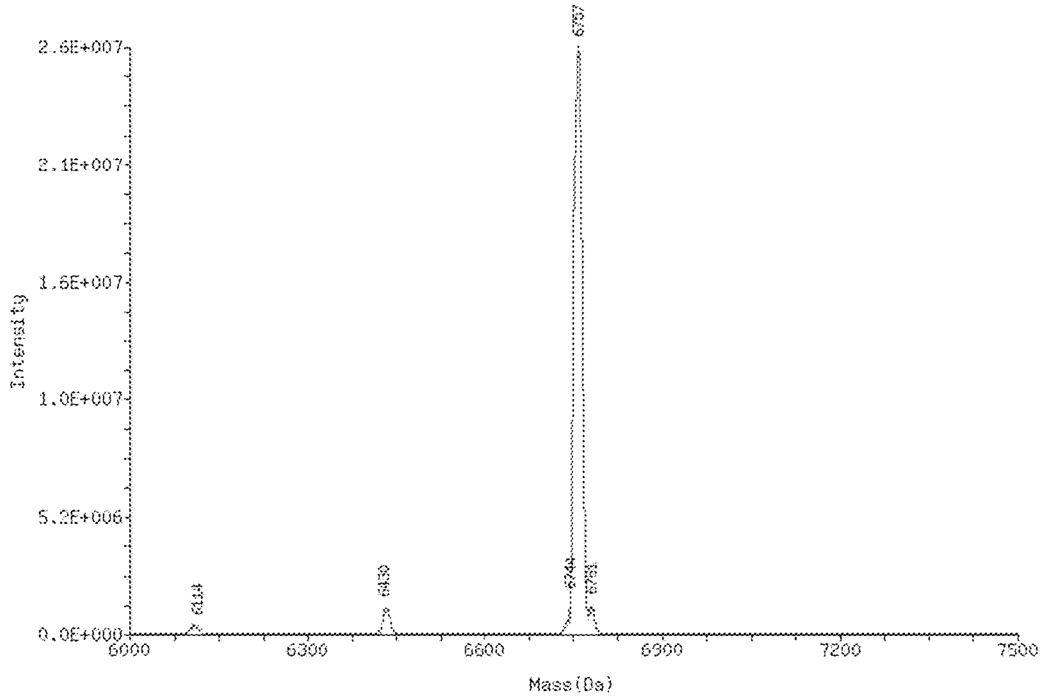
WV2528.01

WV2530.01

FIG. 27N.
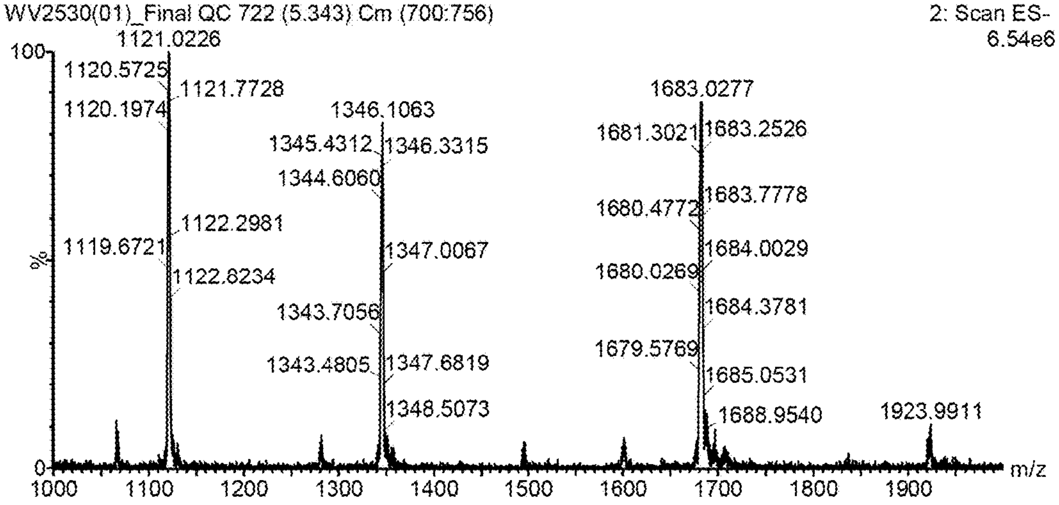
WV2530.01
WV2530.01
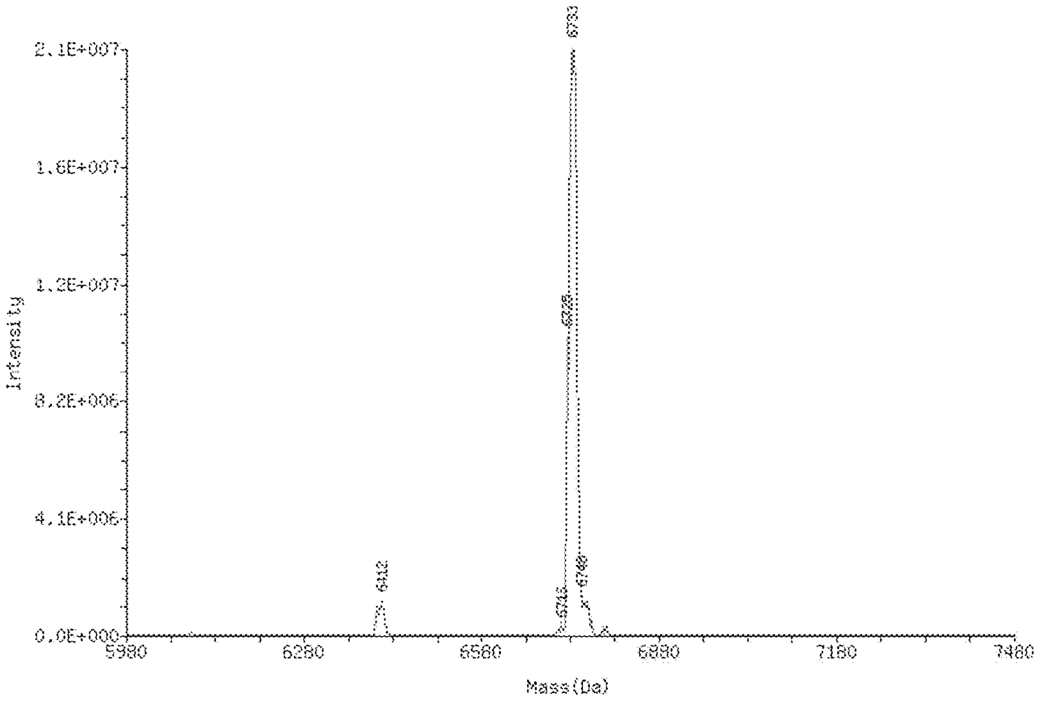

FIG. 27O.

| WV# | Calculated Mass (Da) | Found Mass (Da) |
|---|---|---|
| WV887.02 | 6977.61544 | 6977.5 |
| WV892.02 | 6977.61544 | 6976.8 |
| WV896.01 | 6977.61544 | 6976.5 |
| WV1714.01 | 6833.18920 | 6827.9 |
| WV2444.01 | 6833.18920 | 6832.8 |
| WV2445.01 | 6857.26024 | 6857.6 |
| WV2526.01 | 6797.08264 | 6795 |
| WV2527.01 | 6785.04712 | 6783 |
| WV2528.01 | 6760.97608 | 6757 |
| WV2530.01 | 6736.85032 | 6733 |

Distribution of oligonucleotide in Triceps

OLIGONUCLEOTIDE COMPOSITIONS AND METHODS THEREOF

CROSS-REFERENCE TO RELATED APPLICATIONS

This application is a division of U.S. application Ser. No. 15/766,578, filed Apr. 6, 2018, which is the National Stage of International Application No. PCT/US2016/056123, filed Oct. 7, 2016, which claims priority to United States Provisional Application Nos. 62/239,839, filed Oct. 9, 2015, 62/331,961, filed May 4, 2016, and 62/331,966, filed May 4, 2016, the entirety of each of which is incorporated herein by reference.

SEQUENCE LISTING

The instant application contains a Sequence Listing which has been submitted electronically in XML format and is hereby incorporated by reference in its entirety. Said XML copy, created on Jul. 15, 2023, is named 2010581-1184.xml and is 1.76 megabytes in size.

BACKGROUND

Oligonucleotides are useful in therapeutic, diagnostic, research and nanomaterials applications. The use of naturally occurring nucleic acids (e.g., unmodified DNA or RNA) for therapeutics can be limited, for example, because of their instability against extra- and intracellular nucleases and/or their poor cell penetration and distribution. There is a need for new and improved oligonucleotides and oligonucleotide compositions, such as, e.g., new antisense and siRNA oligonucleotides and oligonucleotide compositions.

SUMMARY

Among other things, the present disclosure encompasses the recognition that structural elements of oligonucleotides, such as base sequence, chemical modifications (e.g., modifications of sugar, base, and/or internucleotidic linkages, and patterns thereof), and/or stereochemistry (e.g., stereochemistry of backbone chiral centers (chiral internucleotidic linkages), and/or patterns thereof), can have significant impact on oligonucleotide properties, e.g., activities, toxicities, e.g., as may be mediated by protein binding characteristics, stability, splicing-altering capabilities, etc. In some embodiments, the present disclosure demonstrates that oligonucleotide compositions comprising oligonucleotides with controlled structural elements, e.g., controlled chemical modification and/or controlled backbone stereochemistry patterns, provide unexpected properties, including but not limited to certain activities, toxicities, etc. In some embodiments, the present disclosure demonstrates that oligonucleotide properties, e.g., activities, toxicities, etc., can be modulated by chemical modifications (e.g., modifications of sugars, bases, internucleotidic linkages, etc.), chiral structures (e.g., stereochemistry of chiral internucleotidic linkages and patterns thereof, etc.), and/or combinations thereof.

Particularly, in some embodiments, the present disclosure provides compositions and methods for altering splicing of transcripts. Splicing of a transcript, such as pre-mRNA, is an essential step for the transcript to perform its biological functions in many higher eukaryotes. Defects and/or insufficiency in the splicing process can affect biological functions and/or have pathological consequences. For example, many human genetic diseases are caused by mutations that cause splicing defects, and many diseases are associated with splicing defects that are not attributed to overt mutations. In some embodiments, the present disclosure recognizes that targeting splicing, especially through compositions comprising oligonucleotides having the chemical modifications and/or stereochemistry patterns described in this disclosure, can effectively correct disease-associated aberrant splicing, and/or introduce and/or enhance beneficial splicing that lead to desired products, e.g., mRNA, proteins, etc. which can repair, restore, or add new desired biological functions. For example, in some embodiments, inclusion of a mutated exon 51 of DMD can cause a frameshift, premature stop codon and/or deletion of one or more downstream exons. In some embodiments, the present disclosure provides compositions and methods for effectively skipping exon 51 of DMD to restore the reading frame so that a shorter but partially functional dystrophin can be produced. In some embodiments, the present disclosure provides compositions and methods for effectively skipping a mutant exon 51 of DMD to restore the reading frame so that a shorter but partially functional dystrophin can be produced. In some embodiments, provided compositions and methods can alter splicing of a transcript to effectively decrease levels of undesired splicing products. For example, in some embodiments, by skipping one or more exons of a pre-mRNA to produce an mRNA with frameshift and/or premature termination codon, provided compositions and methods effectively knockdown a gene; in some embodiments, such a gene is a mutant gene. A person having ordinary skill in the art appreciates that provided technologies (oligonucleotides, compositions, methods, etc.) can also be utilized for exon skipping of other DMD exons, or one or more exons of other transcripts, for example, those described in U.S. Pat. No. 7,534,879 and incorporated herein by reference, in accordance with the present disclosure to treat a disease and/or condition.

In some embodiments, the present disclosure encompass the recognition that chemical modifications, stereochemistry and combinations thereof can be used to improve properties of oligonucleotide compositions including but not limited to their capabilities to modulate splicing of transcripts. In some embodiments, the present disclosure provides chemical modifications and patterns thereof useful for improving transcript splicing by oligonucleotides.

Among other things, the present disclosure demonstrates that stereochemistry can be used to modulate transcript splicing by oligonucleotide compositions. In some embodiments, the present disclosure provides combinations of chemical modifications and stereochemistry to improve properties of oligonucleotides, e.g., their capabilities to alter splicing of transcripts. In some embodiments, the present disclosure provides chirally controlled oligonucleotide compositions that, when compared to a reference condition (e.g., absence of the composition, presence of a reference composition (e.g., a stereorandom composition of oligonucleotides having the same base sequence, the same chemical modifications, etc., a chirally controlled oligonucleotide composition of another stereoisomer, etc.), and combinations thereof), provide altered splicing that can deliver one or more desired biological effects, for example, increase production of desired proteins, knockdown of a gene by producing mRNA with frameshift mutations and/or premature termination codons, knockdown of a gene expressing a mRNA with a frameshift mutation and/or premature termination codon, etc. In some embodiments, compared to a reference condition, provided chirally controlled oligonucleotide compositions are surprisingly effective. In some embodiments, desired biological effects (e.g., as measured by increased levels of desired mRNA, proteins, etc., decreased levels of undesired mRNA, proteins, etc.) can be enhanced by more than 5, 10, 15, 20, 25, 30, 40, 50, or 100 fold.

The present disclosure recognizes challenges of providing low toxicity oligonucleotide compositions and methods thereof. In some embodiments, the present disclosure provides oligonucleotide compositions and methods with reduced toxicity. In some embodiments, the present disclosure provides oligonucleotide compositions and methods with reduced immune responses. In some embodiments, the present disclosure recognizes that various toxicities induced by oligonucleotides are related to complement activation. In some embodiments, the present disclosure provides oligonucleotide compositions and methods with reduced complement activation. In some embodiments, the present disclosure provides oligonucleotide compositions and methods with reduced complement activation via the alternative pathway. In some embodiments, the present disclosure provides oligonucleotide compositions and methods with reduced complement activation via the classical pathway. In some embodiments, the present disclosure provides oligonucleotide compositions and methods with reduced drug-induced vascular injury. In some embodiments, the present disclosure provides oligonucleotide compositions and methods with reduced injection site inflammation. In some embodiments, reduced toxicity can be evaluated through one or more assays widely known to and practiced by a person having ordinary skill in the art, e.g., evaluation of levels of complete activation product, protein binding, etc. as described herein.

In some embodiments, the present disclosure provides oligonucleotides with enhanced antagonism of hTLR9 activity. In some embodiments, certain diseases, e.g., DMD, are associated with inflammation in, e.g., muscle tissues. In some embodiments, provided technologies (e.g., oligonucleotides, compositions, methods, etc.) provides both proteins with enhanced activities (e.g., through exon-skipping of mutant exon 51 (or other exons depending on genotypes) of DMD) and hTLR9 antagonist activities which can be beneficial to one or more conditions and/or diseases associated with inflammation. In some embodiments, provided oligonucleotides and/or compositions thereof provides both exon-skipping capabilities and hTLR9 antagonist activities. In some embodiments, oligonucleotides comprising one or more lipid moieties (e.g., oligonucleotides conjugated with lipids) provide unexpectedly high exon-skipping efficiency and hTLR9 antagonist activities. In some embodiments, a chirally controlled oligonucleotide composition comprising a predetermined level of an oligonucleotide comprising one or more lipid moieties (e.g., oligonucleotides conjugated with lipids) provides unexpectedly high exon-skipping efficiency and hTLR9 antagonist activities In some embodiments, the present disclosure demonstrates that oligonucleotide properties, e.g., activities, toxicities, etc., can be modulated through chemical modifications. In some embodiments, the present disclosure provides an oligonucleotide composition comprising a first plurality of oligonucleotides which have a common base sequence, and comprise one or more modified sugar moieties, one or more natural phosphate linkages, or combinations thereof. In some embodiments, the present disclosure provides an oligonucleotide composition comprising a first plurality of oligonucleotides which have a common base sequence, comprise one or more modified internucleotidic linkages, and comprise one or more modified sugar moieties, one or more natural phosphate linkages, or combinations thereof. For example, in some embodiments, the present disclosure provides an oligonucleotide composition comprising a first plurality of oligonucleotides which have a common base sequence, and comprise one or more modified sugar moieties; in some embodiments, the present disclosure provides an oligonucleotide composition comprising a first plurality of oligonucleotides which have a common base sequence, and comprise one or more modified sugar moieties and one or more natural phosphate linkages; in some embodiments, the present disclosure provides an oligonucleotide composition comprising a first plurality of oligonucleotides which have a common base sequence, and comprise one or more modified sugar moieties and one or more modified internucleotidic linkages; in some embodiments, the present disclosure provides an oligonucleotide composition comprising a first plurality of oligonucleotides which have a common base sequence, and comprise one or more modified sugar moieties, one or more natural phosphate linkages and one or more modified internucleotidic linkages. In some embodiments, provided oligonucleotide composition comprising a first plurality of oligonucleotides are chirally controlled in that level of the first plurality of oligonucleotides is pre-determined, and oligonucleotides of the first plurality share a common stereochemistry configuration at one or more chiral internucleotidic linkages. For example, in some embodiments, oligonucleotides of the first plurality share a common stereochemistry configuration at 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 35, 40, 45, 50 or more chiral internucleotidic linkages, each of which is independently Rp or Sp; in some embodiments, oligonucleotides of the first plurality share a common stereochemistry configuration at each chiral internucleotidic linkages. In some embodiments, a chiral internucleotidic linkage where a predetermined level of oligonucleotides of a composition share a common stereochemistry configuration (independently Rp or Sp) is referred to as a chirally controlled internucleotidic linkage. In some embodiments, a predetermined level of oligonucleotides of a provided composition, e.g., a first plurality of oligonucleotides of certain example compositions, comprise 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 35, 40, 45, 50 or more chiral controlled internucleotidic linkages; in some embodiments, at least 5 internucleotidic linkages are chirally controlled; in some embodiments, at least 10 internucleotidic linkages are chirally controlled; in some embodiments, at least 10 internucleotidic linkages are chirally controlled; in some embodiments, each chiral internucleotidic linkage is chirally controlled. In some embodiments, oligonucleotides of a first plurality have a wing-core-wing structure. In some embodiments, each wing region independently comprises one or more modified phosphate linkages and no natural phosphate linkages, and the core comprises one or more modified internucleotidic linkages and one or more natural phosphate linkages. In some embodiments, each wing region independently comprises one or more natural phosphate linkages and optionally one or more modified internucleotidic linkages, and the core comprises one or more modified internucleotidic linkages and optionally one or more natural phosphate linkages. In some embodiments, each wing region independently comprises one or more natural phosphate linkages and one or more modified internucleotidic linkages, and the core comprises one or more modified internucleotidic linkages and one or more natural phosphate linkages. In some embodiments, each wing region independently comprises one or more natural phosphate linkages and one or more modified internucleotidic linkages, and the core comprises one or more modified internucleotidic linkages and no natural phosphate linkages. In some embodiments, a wing comprises modified sugar moieties. In some embodiments, a modified internucleotidic linkage is phosphorothioate. In some embodiments, a modified internucleotidic linkage is substituted phosphorothioate. In some embodiments, a modified internucleotidic linkage has the structure of formula I described in this disclosure. In some embodiments, a modified sugar moiety is 2'-modified. In some embodiments, a 2'-modification is 2'-$R^1$. In some embodiments, a 2'-modification is 2'-$OR^1$. In some embodiments, a 2'-modification is 2'-F. As described in more details, provided oligonucleotides may comprise more than one types of sugar modifications; in some embodiments, provided oligonucleotides comprise both 2'-F and 2'-$OR^1$ modifications. In some embodiments, provided oligonucleotides comprise both 2'-F and 2'-OMe modifications. In some embodiments, provided oligonucleotides comprise both 2'-F and 2'-OMe modifications, and both phosphorothioate and natural phosphate linkages. In some embodiments, each chiral internucleotidic linkage, e.g., phosphorothioate linkage, is chirally controlled. In some embodiments, such provided compositions have lower toxicity. In some embodiments, provided compositions have lower complement activation.

In some embodiments, the present disclosure provides oligonucleotide compositions with improved protein binding profiles, e.g., lowered harmful protein binding and/or increased beneficial protein binding. In some embodiments, the present disclosure provides methods for improved delivery of oligonucleotide compositions comprising providing oligonucleotide compositions with improved protein binding profile. In some embodiments, the present disclosure demonstrates that protein binding by oligonucleotide compositions can be modulated through chemical modifications, stereochemistry, or combinations thereof. In some embodiments, protein binding by oligonucleotide compositions can be modulated by incorporation of modified internucleotidic linkages. In some embodiments, an increased percentage of modified internucleotidic linkages provides increased binding of oligonucleotides to certain proteins. In some embodiments, replacement of one or more modified internucleotidic linkages with natural phosphate linkages provides decreased binding to certain proteins. In some embodiments, replacement of one or more natural phosphate linkages with modified internucleotidic linkages provides increased binding to certain proteins. In some embodiments, certain chemical modifications provide increased protein binding to certain proteins. In some embodiments, certain chemical modifications provide decreased protein binding to certain proteins. In some embodiments, different chemical modifications of the same kind provide different protein binding. For example, in some embodiments, 2'-MOE provides decreased protein binding compared to 2'-OMe (at least in certain contexts—e.g., sequence, stereochemistry, etc.).

Among other things, the present disclosure encompasses the recognition that stereorandom oligonucleotide preparations contain a plurality of distinct chemical entities that differ from one another, e.g., in the stereochemical structure of individual backbone chiral centers within the oligonucleotide chain. Without control of stereochemistry of backbone chiral centers, stereorandom oligonucleotide preparations provide uncontrolled compositions comprising undetermined levels of oligonucleotide stereoisomers. Even though these stereoisomers may have the same base sequence and/or chemical modifications, they are different chemical entities at least due to their different backbone stereochemistry, and they can have, as demonstrated herein, different properties, e.g., activities, toxicities, distribution etc. Among other things, the present disclosure provides chirally controlled compositions that are or contain particular stereoisomers of oligonucleotides of interest; in contrast to chirally uncontrolled compositions, chirally controlled compositions comprise predetermined levels of particular stereoisomers of oligonucleotides. In some embodiments, a particular stereoisomer may be defined, for example, by its base sequence, its length, its pattern of backbone linkages, and its pattern of backbone chiral centers. As is understood in the art, in some embodiments, base sequence may refer to the identity and/or modification status of nucleoside residues (e.g., of sugar and/or base components, relative to standard naturally occurring nucleotides such as adenine, cytosine, guanosine, thymine, and uracil) in an oligonucleotide and/or to the hybridization character (i.e., the ability to hybridize with particular complementary residues) of such residues. In some embodiments, the present disclosure demonstrates that property improvements (e.g., improved activities, lower toxicities, etc.) achieved through inclusion and/or location of particular chiral structures within an oligonucleotide can be comparable to, or even better than those achieved through use of chemical modification, e.g., particular backbone linkages, residue modifications, etc. (e.g., through use of certain types of modified phosphates [e.g., phosphorothioate, substituted phosphorothioate, etc.], sugar modifications [e.g., 2'-modifications, etc.], and/or base modifications [e.g., methylation, etc.]). In some embodiments, the present disclosure demonstrates that chirally controlled oligonucleotide compositions of oligonucleotides comprising certain chemical modifications (e.g., 2'-F, 2'-OMe, phosphorothioate internucleotidic linkages, lipid conjugation, etc.) demonstrate unexpectedly high exon-skipping efficiency.

Among other things, the present disclosure demonstrates that stereochemistry can be used to modulate toxicity of oligonucleotide compositions. In some embodiments, the present disclosure provides chirally controlled oligonucleotide compositions that have lower toxicity when compared to a corresponding stereorandom (or chirally uncontrolled) oligonucleotide composition of oligonucleotides sharing the same base sequence and chemical modifications. In some embodiments, chirally controlled oligonucleotide compositions of oligonucleotides comprising more Rp chiral internucleotidic linkage have lower toxicity. In some embodiments, chirally controlled oligonucleotide compositions of oligonucleotides having a single Rp chiral internucleotidic linkage have increased toxicity compared to other chirally controlled oligonucleotide compositions and/or the corresponding stereorandom oligonucleotide composition of oligonucleotides sharing the same base sequence and chemical modifications. In some embodiments, a single Rp chiral internucleotidic linkage is in the middle of a sequence. In some embodiments, chirally controlled oligonucleotide compositions of oligonucleotides which comprise one or more Rp chiral internucleotidic linkages at the 5'- and/or the 3'-end provide lower toxicity. In some embodiments, chirally controlled oligonucleotide compositions of oligonucleotides which comprise one or more natural phosphate linkages at the 5'- and/or the 3'-end provide lower toxicity. In some embodiments, a chiral internucleotidic linkage has the structure of formula I. In some embodiments, a chiral internucleotidic linkage is a phosphorothioate linkage. In some embodiments, a chiral internucleotidic linkage is a substituted phosphorothioate linkage.

Among other things, the present disclosure recognizes that, in some embodiments, properties (e.g., activities, toxicities, distribution, pharmacokinetics, etc.) of an oligonucleotide can be adjusted by optimizing its pattern of backbone chiral centers, optionally in combination with adjustment/optimization of one or more other features (e.g., chemical modifications, patterns of modifications such as linkage pattern, nucleoside modification pattern, conjugation to lipids or other moieties, etc.) of the oligonucleotide. In some embodiments, the present disclosure recognizes that, in some embodiments, properties (e.g., activities, toxicities, etc.) of an oligonucleotide can be adjusted by optimizing its pattern of backbone chiral centers, optionally in combination with adjustment/optimization of one or more other features (e.g., chemical modifications, patterns of modifications such as linkage pattern, nucleoside modification pattern, etc.) of the oligonucleotide. In some embodiments, the present disclosure recognizes and demonstrates that chemical modifications, such as modifications of nucleosides and internucleotidic linkages, can provide enhanced properties. In some embodiments, the present disclosure demonstrates that combinations of chemical modifications and stereochemistry can provide unexpected, greatly improved properties (e.g., activities, toxicities, distribution, pharmacokinetics, etc.). In some embodiments, the present disclosure demonstrates that combinations of chemical modifications and stereochemistry can provide unexpected, greatly improved properties (e.g., activities, toxicities, distribution, pharmacokinetics, etc.). In some embodiments, chemical combinations, such as modifications of sugars, bases, and/or internucleotidic linkages, are combined with stereochemistry patterns to provide oligonucleotides and compositions thereof with surprisingly enhanced properties including low toxicity, better protein binding profile, etc. In some embodiments, a provided oligonucleotide composition comprising a first plurality of oligonucleotides is chirally controlled, and oligonucleotides of the first plurality comprise a combination of 2'-modification of one or more sugar moieties, one or more natural phosphate linkages, and one or more chiral internucleotidic linkages. In some embodiments, a provided oligonucleotide composition comprising a first plurality of oligonucleotides is chirally controlled, and oligonucleotides of the first plurality comprise a combination of 2'-modification of one or more sugar moieties, one or more natural phosphate linkages, one or more chiral internucleotidic linkages, wherein the 5'- and/or the 3'-end internucleotidic linkages are chiral. In some embodiments, both the 5'- and the 3'-end internucleotidic linkages are chiral. In some embodiments, both the 5'- and the 3'-end internucleotidic linkages are chiral and Sp. In some embodiments, a provided oligonucleotide composition comprising a first plurality of oligonucleotides is chirally controlled, and oligonucleotides of the first plurality comprise a combination of 2'-modification of one or more sugar moieties, one or more natural phosphate linkages, one or more chiral internucleotidic linkages, and a stereochemistry pattern of (Rp)n(Sp)m, (Np)t(Rp)n(Sp)m, or (Sp)t(Rp)n(Sp)m, wherein m>2. In some embodiments, a chiral internucleotidic linkage has the structure of formula I. In some embodiments, a chiral internucleotidic linkage is a phosphorothioate linkage. In some embodiments, a chiral internucleotidic linkage is a substituted phosphorothioate linkage.

In some embodiments, provided oligonucleotides comprise a wing and a core region. In some embodiments, provided oligonucleotides have a wing-core-wing structure, wherein the core region comprises one or more sugar moieties and/or internucleotidic linkages not in the wing regions. In some embodiments, provided oligonucleotides have a wing-core-wing structure, wherein the core region comprises one or more sugar moieties and internucleotidic linkages not in the wing regions. In some embodiments, provided oligonucleotides have a wing-core-wing structure, wherein the core region comprises one or more sugar moieties not in the wing regions. In some embodiments, provided oligonucleotides have a wing-core-wing structure, wherein the core region comprises one or more internucleotidic linkages not in the wing regions. In some embodiments, a core region comprises a modified sugar moiety. In some embodiments, each sugar moiety in a core region is modified. Example sugar modifications are widely known in the art including but not limited to those described in this disclosure. In some embodiments, a core comprises at least one internucleotidic linkage which is chirally controlled (e.g., a phosphorothioate in Sp or Rp configuration) and at least one internucleotidic linkage which is not chiral (e.g., a phosphodiester or phosphorodithioate). In some embodiments, a core comprises at least one internucleotidic linkage which is chirally controlled phosphorothioate in Sp configuration and at least one internucleotidic linkage which is not chiral (e.g., a phosphodiester or phosphorodithioate). In some embodiments, each wing region comprises no modified sugar moieties. In some embodiments, a core region comprises one or more natural phosphate linkages. In some embodiments, each internucleotidic linkage following a core nucleoside is natural phosphate linkage. In some embodiments, a wing comprises at least one internucleotidic linkage which is chirally controlled (e.g., a phosphorothioate in Sp or Rp configuration) and at least one internucleotidic linkage which is not chiral (e.g., a phosphodiester or phosphorodithioate). In some embodiments, a wing comprises at least one internucleotidic linkage which is chirally controlled phosphorothioate in Sp configuration and at least one internucleotidic linkage which is not chiral (e.g., a phosphodiester or phosphorodithioate). In some embodiments, a wing comprises one or more modified internucleotidic linkages. In some embodiments, each internucleotidic linkage following a core nucleoside is a modified internucleotidic linkage. For example, see WV-1111. In some embodiments, an oligonucleotide comprises at least one internucleotidic linkage which is chirally controlled (e.g., a phosphorothioate in Sp or Rp configuration) and at least one internucleotidic linkage which is not chiral at the linkage phosphorus (e.g., a phosphodiester or phosphorodithioate). In some embodiments, an oligonucleotide comprises at least one internucleotidic linkage which is chirally controlled phosphorothioate in Sp configuration and at least one internucleotidic linkage which is not chiral at the linkage phosphorus (e.g., a phosphodiester or phosphorodithioate).

In some embodiments, provided oligonucleotides are blockmers. In some embodiments, provided oligonucleotide are altmers. In some embodiments, provided oligonucleotides are altmers comprising alternating blocks. In some embodiments, a blockmer or an altmer can be defined by chemical modifications (including presence or absence), e.g., base modifications, sugar modification, internucleotidic linkage modifications, stereochemistry, etc.

In some embodiments, provided oligonucleotides comprise blocks comprising different internucleotidic linkages. In some embodiments, provided oligonucleotides comprise blocks comprising modified internucleotidic linkages and natural phosphate linkages. In some embodiments, provided oligonucleotides comprise blocks comprising different modified internucleotidic linkages. In some embodiments, provided oligonucleotides comprise alternating blocks comprising different internucleotidic linkages. In some embodiments, provided oligonucleotides comprise alternating blocks comprising modified internucleotidic linkages and natural phosphate linkages. In some embodiments, provided oligonucleotides comprise alternating blocks comprising different modified internucleotidic linkages. In some embodiments, a block comprising modified internucleotidic linkages have pattern of backbone chiral centers as described herein. In some embodiments, each block comprising modified internucleotidic linkages has the same pattern of backbone chiral centers. In some embodiments, blocks comprising modified internucleotidic linkages have different patterns of backbone chiral centers. In some embodiments, blocks comprising modified internucleotidic linkages have different length and/or modifications. In some embodiments, blocks comprising modified internucleotidic linkages have the same length and/or modifications. In some embodiments, blocks comprising modified internucleotidic linkages have the same length. In some embodiments, blocks comprising modified internucleotidic linkages have the same internucleotidic linkages. In some embodiments, provided oligonucleotides comprise a first block at the 5'-end (5'-block), and a second block at the 3'-end (3'-block), each of which independently comprise one or more modified internucleotidic linkages. In some embodiments, each of the 5'- and 3'-blocks independently comprises 2, 3, 4, 5, 6, 7, 8, 9, 10, 11, 12, 13, 14, 15, 16, 17, 18, 19, 20 or more modified internucleotidic linkages. In some embodiments, a 5'-block comprises 4 or more modified internucleotidic linkages. In some embodiments, a 5'-block comprises 5 or more modified internucleotidic linkages. In some embodiments, a 5'-block comprises 6 or more modified internucleotidic linkages. In some embodiments, a 5'-block comprises 7 or more modified internucleotidic linkages. In some embodiments, a 3'-block comprises 4 or more modified internucleotidic linkages. In some embodiments, a 3'-block comprises 5 or more modified internucleotidic linkages. In some embodiments, a 3'-block comprises 6 or more modified internucleotidic linkages. In some embodiments, a 3'-block comprises 7 or more modified internucleotidic linkages. In some embodiments, each of the 5'- and 3'-blocks independently comprises at least 4 modified internucleotidic linkages. In some embodiments, each of the 5'- and 3'-blocks independently comprises at least 5 modified internucleotidic linkages. In some embodiments, each of the 5'- and 3'-blocks independently comprises at least 6 modified internucleotidic linkages. In some embodiments, each of the 5'- and 3'-blocks independently comprises at least 7 modified internucleotidic linkages. In some embodiments, modified internucleotidic linkages within a block are consecutive. In some embodiments, each linkage of the 5'-block is independently a modified internucleotidic linkage. In some embodiments, each linkage of the 5'-block is independently a phosphorothioate linkage. In some embodiments, each linkage of the 5'-block is independently chirally controlled. In some embodiments, each linkage of the 5'-block is Sp. In some embodiments, each linkage of the 3'-block is independently a modified internucleotidic linkage. In some embodiments, each linkage of the 3'-block is independently a phosphorothioate linkage. In some embodiments, each linkage of the 3'-block is independently chirally controlled. In some embodiments, each linkage of the 3'-block is Sp.

In some embodiments, provided oligonucleotides comprise blocks comprising sugar modifications. In some embodiments, provided oligonucleotides comprise one or more blocks comprising one or more 2'-F modifications (2'-F blocks). In some embodiments, provided oligonucleotides comprise blocks comprising consecutive 2'-F modifications. In some embodiments, a block comprises 2, 3, 4, 5, 6, 7, 8, 9, 10, 11, 12, 13, 14, 15, 16, 17, 18, 19, 20 or more consecutive 2'-F modifications. In some embodiments, a block comprises 4 or more 2'-F modifications. In some embodiments, a block comprises 5 or more 2'-F modifications. In some embodiments, a block comprises 6 or more 2'-F modifications. In some embodiments, a block comprises 7 or more 2'-F modifications. In some embodiments, provided oligonucleotides comprises one or more blocks comprising one or more 2'-$OR^1$ modifications (2'-$OR^1$ blocks). In some embodiments, provided oligonucleotides comprise both 2'-F and 2'-$OR^1$ blocks. In some embodiments, provided oligonucleotides comprise alternating 2'-F and 2'-$OR^1$ blocks. In some embodiments, provided oligonucleotides comprise a first 2'-F block at the 5'-end, and a second 2'-F block at the 3'-end, each of which independently comprises 2, 3, 4, 5, 6, 7, 8, 9, 10, 11, 12, 13, 14, 15, 16, 17, 18, 19, 20 or more consecutive 2'-F modifications; in some embodiments, each of which independently comprises 4 or more 2'-F modifications; in some embodiments, each of which independently comprises 5 or more 2'-F modifications; in some embodiments, each of which independently comprises 6 or more 2'-F modifications; in some embodiments, each of which independently comprises 7 or more 2'-F modifications. In some embodiments, provided oligonucleotides comprise a 5'-block wherein each sugar moiety of the 5'-block comprises a 2'-F modification. In some embodiments, provided oligonucleotides comprise a 3'-block wherein each sugar moiety of the 3'-block comprises a 2'-F modification. In some embodiments, such provided oligonucleotides comprise one or more 2'-$OR^1$ blocks, and optionally one or more 2'-F blocks, between the 5' and 3' 2'-F blocks. In some embodiments, such provided oligonucleotides comprise one or more 2'-$OR^1$ blocks, and one or more 2'-F blocks, between the 5' and 3' 2'-F blocks (e.g., WV-3407, WV-3408, etc.).

In some embodiments, a block is a stereochemistry block. In some embodiments, a block is an Rp block in that each internucleotidic linkage of the block is Rp. In some embodiments, a 5'-block is an Rp block. In some embodiments, a 3'-block is an Rp block. In some embodiments, a block is an Sp block in that each internucleotidic linkage of the block is Sp. In some embodiments, a 5'-block is an Sp block. In some embodiments, a 3'-block is an Sp block. In some embodiments, provided oligonucleotides comprise both Rp and Sp blocks. In some embodiments, provided oligonucleotides comprise one or more Rp but no Sp blocks. In some embodiments, provided oligonucleotides comprise one or more Sp but no Rp blocks. In some embodiments, provided oligonucleotides comprise one or more PO blocks wherein each internucleotidic linkage in a natural phosphate linkage.

In some embodiments, a 5'-block is an Sp block wherein each sugar moiety comprises a 2'-F modification. In some embodiments, a 5'-block is an Sp block wherein each of internucleotidic linkage is a modified internucleotidic linkage and each sugar moiety comprises a 2'-F modification. In some embodiments, a 5'-block is an Sp block wherein each of internucleotidic linkage is a phosphorothioate linkage and each sugar moiety comprises a 2'-F modification. In some embodiments, a 5'-block comprises 4 or more nucleoside units. In some embodiments, a 5'-block comprises 5 or more nucleoside units. In some embodiments, a 5'-block comprises 6 or more nucleoside units. In some embodiments, a 5'-block comprises 7 or more nucleoside units. In some embodiments, a 3'-block is an Sp block wherein each sugar moiety comprises a 2'-F modification. In some embodiments, a 3'-block is an Sp block wherein each of internucleotidic linkage is a modified internucleotidic linkage and each sugar moiety comprises a 2'-F modification. In some embodiments, a 3'-block is an Sp block wherein each of internucleotidic linkage is a phosphorothioate linkage and each sugar moiety comprises a 2'-F modification. In some embodiments, a 3'-block comprises 4 or more nucleoside units. In some embodiments, a 3'-block comprises 5 or more nucleoside units. In some embodiments, a 3'-block comprises 6 or more nucleoside units. In some embodiments, a 3'-block comprises 7 or more nucleoside units.

In some embodiments, a type of nucleoside in a region or an oligonucleotide is followed by a specific type of internucleotidic linkage, e.g., natural phosphate linkage, modified internucleotidic linkage, Rp chiral internucleotidic linkage, Sp chiral internucleotidic linkage, etc. In some embodiments, A is followed by Sp. In some embodiments, A is followed by Rp. In some embodiments, A is followed by natural phosphate linkage (PO). In some embodiments, U is followed by Sp. In some embodiments, U is followed by Rp. In some embodiments, U is followed by natural phosphate linkage (PO). In some embodiments, C is followed by Sp. In some embodiments, C is followed by Rp. In some embodiments, C is followed by natural phosphate linkage (PO). In some embodiments, G is followed by Sp. In some embodiments, G is followed by Rp. In some embodiments, G is followed by natural phosphate linkage (PO). In some embodiments, C and U are followed by Sp. In some embodiments, C and U are followed by Rp. In some embodiments, C and U are followed by natural phosphate linkage (PO). In some embodiments, A and G are followed by Sp. In some embodiments, A and G are followed by Rp. In some embodiments, A and G are followed by natural phosphate linkage (PO). For examples, see WV-1111, WV-1112, WV-XXX1, etc.

In some embodiments, provided oligonucleotides comprise alternating blocks comprising modified sugar moieties and unmodified sugar moieties. In some embodiments, modified sugar moieties comprise 2'-modifications. In some embodiments, provided oligonucleotides comprise alternating 2'-OMe modified sugar moieties and unmodified sugar moieties. For examples, see WV-1112, WV-1113, etc.

In some embodiments, provided oligonucleotides comprise alternating blocks comprising different modified sugar moieties and/or unmodified sugar moieties. In some embodiments, provided oligonucleotides comprise alternating blocks comprising different modified sugar moieties and unmodified sugar moieties. In some embodiments, provided oligonucleotides comprise alternating blocks comprising different modified sugar moieties. In some embodiments, provided oligonucleotides comprise alternating blocks comprising different modified sugar moieties, wherein the modified sugar moieties comprise different 2'-modifications. For example, in some embodiments, provided oligonucleotide comprises alternating blocks comprising 2'-OMe and 2'-F, respectively. For examples, see WV-1712, WV1713, WV-1714, etc.

In some embodiments, a type of nucleoside in a region or an oligonucleotide is modified, optionally with a different modification compared to another type of nucleoside. In some embodiments, a type of nucleoside in a region or an oligonucleotide is modified with a different modification compared to another type of nucleoside. For example, in some embodiments, a pyrimidine nucleoside comprises a 2'-F modification, and a purine nucleoside comprises a 2'-OMe modification. In some other embodiments, a pyrimidine nucleoside comprises a 2'-OMe modification, and a purine nucleoside comprises a 2'-F modification. In some embodiments, G and C has one type of sugar modification, and A and U has another type of sugar modification. In some embodiments, G and C comprises 2'-OMe modification, and A and U comprises 2'-F modification. In some embodiments, G and C comprises 2'-F modification, and A and U comprises 2'-OMe modification.

In some embodiments, an internucleotidic linkage following an unmodified sugar moiety is a modified internucleotidic linkage. In some embodiments, an internucleotidic linkage after an unmodified sugar moiety is a phosphorothioate linkage. In some embodiments, each internucleotidic linkage after an unmodified sugar moiety is a modified internucleotidic linkage. In some embodiments, each internucleotidic linkage after an unmodified sugar moiety is a phosphorothioate linkage. In some embodiments, an internucleotidic linkage following a modified sugar moiety is a natural phosphate linkage. In some embodiments, each internucleotidic linkage following a modified sugar moiety is a natural phosphate linkage. For example, see WV-1111, WV1112, etc.

In some embodiments, provided oligonucleotides comprise one or more 2'-F modified sugar moieties whose 3'-internucleotidic linkages are modified internucleotidic linkages. In some embodiments, a modified internucleotidic linkage is phosphorothioate. In some embodiments, a modified internucleotidic linkage is chirally controlled and is Rp. In some embodiments, a modified internucleotidic linkage is chirally controlled and is Sp. In some embodiments, provided oligonucleotides comprise one or more 2'-$OR^1$ modified sugar moieties whose 3'-internucleotidic linkages are natural phosphate linkages.

In some embodiments, a provided pattern of backbone chiral centers comprises repeating (Sp)m(Rp)n, (Rp)n(Sp)m, (Np)t(Rp)n(Sp)m, or (Sp)t(Rp)n(Sp)m units. In some embodiments, a repeating unit is (Sp)m(Rp)n. In some embodiments, a repeating unit is SpRp. In some embodiments, a repeating unit is SpSpRp. In some embodiments, a repeating unit is SpRpRp. In some embodiments, a repeating unit is RpRpSp. In some embodiments, a repeating unit is (Rp)n(Sp)m. In some embodiments, a repeating unit is (Np)t(Rp)n(Sp)m. In some embodiments, a repeating unit is (Sp)t(Rp)n(Sp)m.

In some embodiments, a provided pattern of backbone chiral centers comprises (Rp/Sp)-(All Rp or All Sp)-(Rp/Sp). In some embodiments, a provided pattern of backbone chiral centers comprises (Rp)-(All Sp)-(Rp). In some embodiments, a provided pattern of backbone chiral centers comprises (Sp)-(All Sp)-(Sp). In some embodiments, a provided pattern of backbone chiral centers comprises (Sp)-(All Rp)-(Sp). In some embodiments, a provided pattern of backbone chiral centers comprises (Rp/Sp)-(repeating (Sp)m(Rp)n)-(Rp/Sp). In some embodiments, a provided pattern of backbone chiral centers comprises (Rp/Sp)-(repeating SpSpRp)-(Rp/Sp).

In some embodiments, a provided pattern of backbone chiral centers is (Rp/Sp)-(All Rp or All Sp)-(Rp/Sp). In some embodiments, a provided pattern of backbone chiral centers is (Sp)-(All Sp)-(Sp). In some embodiments, each chiral internucleotidic linkage is Sp. In some embodiments, a provided pattern of backbone chiral centers is (Rp)-(All Sp)-(Rp). In some embodiments, a provided pattern of backbone chiral centers is (Sp)-(All Rp)-(Sp). In some embodiments, a provided pattern of backbone chiral centers is (Rp/Sp)-(repeating (Sp)m(Rp)n)-(Rp/Sp). In some embodiments, a provided pattern of backbone chiral centers is (Rp/Sp)-(repeating SpSpRp)-(Rp/Sp).

In some embodiments, the present disclosure provides oligonucleotide compositions having low toxicity. In some embodiments, the present disclosure provides oligonucleotide compositions having improved protein binding profile. In some embodiments, the present disclosure provides oligonucleotide compositions having improved binding to albumin. In some embodiments, provided compositions have low toxicity and improved binding to certain desired proteins. In some embodiments, provided compositions have low toxicity and improved binding to certain desired proteins. In some embodiments, provided oligonucleotide compositions at the same time provides the same level of, or greatly enhanced, stability and/or activities, e.g., better target-cleavage pattern, better target-cleavage efficiency, better target specificity, etc.

In some embodiments, the present disclosure provides an oligonucleotide composition comprising a first plurality of oligonucleotides which:

1) have a common base sequence complementary to a target sequence in a transcript; and
2) comprise one or more modified sugar moieties and modified internucleotidic linkages.

In some embodiments, a provided oligonucleotide composition is characterized in that, when it is contacted with the transcript in a transcript splicing system, splicing of the transcript is altered relative to that observed under reference conditions selected from the group consisting of absence of the composition, presence of a reference composition, and combinations thereof.

In some embodiments, a reference condition is absence of the composition. In some embodiments, a reference condition is presence of a reference composition. Example reference compositions comprising a reference plurality of oligonucleotides are extensively described in this disclosure. In some embodiments, oligonucleotides of the reference plurality have a different structural elements (chemical modifications, stereochemistry, etc.) compared with oligonucleotides of the first plurality in a provided composition. In some embodiments, a reference composition is a stereorandom preparation of oligonucleotides having the same chemical modifications. In some embodiments, a reference composition is a mixture of stereoisomers while a provided composition is a chirally controlled oligonucleotide composition of one stereoisomer. In some embodiments, oligonucleotides of the reference plurality have the same base sequence as oligonucleotide of the first plurality in a provided composition. In some embodiments, oligonucleotides of the reference plurality have the same chemical modifications as oligonucleotide of the first plurality in a provided composition. In some embodiments, oligonucleotides of the reference plurality have the same sugar modifications as oligonucleotide of the first plurality in a provided composition. In some embodiments, oligonucleotides of the reference plurality have the same base modifications as oligonucleotide of the first plurality in a provided composition. In some embodiments, oligonucleotides of the reference plurality have the same internucleotidic linkage modifications as oligonucleotide of the first plurality in a provided composition. In some embodiments, oligonucleotides of the reference plurality have the same stereochemistry as oligonucleotide of the first plurality in a provided composition but different chemical modifications, e.g., base modification, sugar modification, internucleotidic linkage modifications, etc.

Example splicing systems are widely known in the art. In some embodiments, a splicing system is an in vivo or in vitro system including components sufficient to achieve splicing of a relevant target transcript. In some embodiments, a splicing system is or comprises a spliceosome (e.g., protein and/or RNA components thereof). In some embodiments, a splicing system is or comprises an organellar membrane (e.g., a nuclear membrane) and/or an organelle (e.g., a nucleus). In some embodiments, a splicing system is or comprises a cell or population thereof. In some embodiments, a splicing system is or comprises a tissue. In some embodiments, a splicing system is or comprises an organism, e.g., an animal, e.g., a mammal such as a mouse, rat, monkey, human, etc.

In some embodiments, the present disclosure provides an oligonucleotide composition comprising a first plurality of oligonucleotides which:

1) have a common base sequence complementary to a target sequence in a transcript; and
2) comprise one or more modified sugar moieties and modified internucleotidic linkages, the oligonucleotide composition being characterized in that, when it is contacted with the transcript in a transcript splicing system, splicing of the transcript is altered relative to that observed under reference conditions selected from the group consisting of absence of the composition, presence of a reference composition, and combinations thereof.

In some embodiments, the present disclosure provides an oligonucleotide composition comprising a first plurality of oligonucleotides of a particular oligonucleotide type defined by:

1) base sequence;
2) pattern of backbone linkages;
3) pattern of backbone chiral centers; and
4) pattern of backbone phosphorus modifications.

In some embodiments, the present disclosure provides an oligonucleotide composition comprising a first plurality of oligonucleotides of a particular oligonucleotide type defined by:

1) base sequence;
2) pattern of backbone linkages;
3) pattern of backbone chiral centers; and
4) pattern of backbone phosphorus modifications, which composition is chirally controlled in that it is enriched, relative to a substantially racemic preparation of oligonucleotides having the same base sequence, for oligonucleotides of the particular oligonucleotide type, the oligonucleotide composition being characterized in that, when it is contacted with the transcript in a transcript splicing system, splicing of the transcript is altered relative to that observed under reference conditions selected from the group consisting of absence of the composition, presence of a reference composition, and combinations thereof.

In some embodiments, the present disclosure provides an oligonucleotide composition comprising a first plurality of oligonucleotides comprising one or more wing regions and a core region, wherein:

oligonucleotides of the first plurality have the same base sequence; and each wing region independently comprises one or more modified internucleotidic linkages and optionally one or more natural phosphate linkages, and the core region independently comprises one or more modified internucleotidic linkages; or each wing region independently comprises one or more modified sugar moieties, and the core region comprises one or more un-modified sugar moieties.

In some embodiments, the present disclosure provides an oligonucleotide composition comprising a first plurality of oligonucleotides comprising one or more wing regions and a core region, wherein:

oligonucleotides of the first plurality have the same base sequence;

each wing region independently has a length of two or more bases, and independently comprises one or more modified internucleotidic linkages and optionally one or more natural phosphate linkages; and the core region independently has a length of two or more bases and independently comprises one or more modified internucleotidic linkages.

In some embodiments, the present disclosure provides an oligonucleotide composition comprising a first plurality of oligonucleotides comprising one or more wing regions and a core region, wherein:

oligonucleotides of the first plurality have the same base sequence;

each wing region independently has a length of two or more bases, and independently comprises one or more modified internucleotidic linkages and one or more natural phosphate linkages; and the core region independently has a length of two or more bases and independently comprises one or more modified internucleotidic linkages.

In some embodiments, the present disclosure provides an oligonucleotide composition comprising a first plurality of oligonucleotides comprising two wing regions and a core region, wherein:

oligonucleotides of the first plurality have the same base sequence;

each wing region independently has a length of two or more bases, and independently comprises one or more modified internucleotidic linkages and one or more natural phosphate linkages; and the core region independently has a length of two or more bases and independently comprises one or more modified internucleotidic linkages.

In some embodiments, the present disclosure provides an oligonucleotide composition comprising a first plurality of oligonucleotides comprising two wing regions and a core region, wherein:

oligonucleotides of the first plurality have the same base sequence;

each wing region independently has a length of two or more bases, and independently comprises one or more modified internucleotidic linkages and one or more natural phosphate linkages;

the wing region to the 5'-end of the core region comprises at least one modified internucleotidic linkage followed by a natural phosphate linkage in the wing; and the wing region to the 3'-end of the core region comprises at least one modified internucleotidic linkage preceded by a natural phosphate linkage in the wing;

the core region independently has a length of two or more bases and independently comprises one or more modified internucleotidic linkages.

In some embodiments, the present disclosure provides an oligonucleotide composition comprising a first plurality of oligonucleotides comprising a wing region and a core region, wherein:

oligonucleotides of the first plurality have the same base sequence;

the wing region has a length of two or more bases, and comprises one or more modified internucleotidic linkages and one or more natural phosphate linkages;

the wing region is to the 5'-end of the core region and comprises a natural phosphate linkage between the two nucleosides at its 3'-end, or the wing region to the 3'-end of the core region and comprises a natural phosphate linkage between the two nucleosides at its 5'-end; and the core region independently has a length of two or more bases and independently comprises one or more modified internucleotidic linkages.

In some embodiments, the present disclosure provides an oligonucleotide composition comprising a first plurality of oligonucleotides comprising two wing regions and a core region, wherein:

oligonucleotides of the first plurality have the same base sequence;

each wing region independently has a length of two or more bases, and independently comprises one or more modified internucleotidic linkages and one or more natural phosphate linkages;

the wing region to the 5'-end of the core region comprises a natural phosphate linkage between the two nucleosides at its 3'-end;

the wing region to the 3'-end of a core region comprises a natural phosphate linkage between the two nucleosides at its 5'-end; and the core region independently has a length of two or more bases and independently comprises one or more modified internucleotidic linkages.

In some embodiments, the present disclosure provides an oligonucleotide composition comprising a first plurality of oligonucleotides comprising one or more wing regions and a core region, wherein:

oligonucleotides of the first plurality have the same base sequence; and each wing region independently comprises one or more modified internucleotidic linkages and optionally one or more natural phosphate linkages, and the core region independently comprises one or more modified internucleotidic linkages; and each wing region independently comprises one or more modified sugar moieties, and the core region comprises one or more un-modified sugar moieties.

In some embodiments, the present disclosure provides an oligonucleotide composition comprising a first plurality of oligonucleotides comprising one or more wing regions and a core region, wherein:

oligonucleotides of the first plurality have the same base sequence; and each wing region independently comprises one or more modified internucleotidic linkages and one or more natural phosphate linkages, and the core region independently comprises one or more modified internucleotidic linkages; and each wing region independently comprises one or more modified sugar moieties, and the core region comprises one or more un-modified sugar moieties.

In some embodiments, the present disclosure provides an oligonucleotide composition comprising a first plurality of oligonucleotides which:

1) have a common base sequence; and 2) comprise one or more wing regions and a core region; wherein:

each wing region comprises at least one modified sugar moiety; and each core region comprises at least one un-modified sugar moiety.

In some embodiments, the present disclosure provides a chirally controlled oligonucleotide composition comprising oligonucleotides defined by having:

1) a common base sequence and length;
2) a common pattern of backbone linkages; and
3) a common pattern of backbone chiral centers, which composition is a substantially pure preparation of a single oligonucleotide in that a predetermined level of the oligonucleotides in the composition have the common base sequence and length, the common pattern of backbone linkages, and the common pattern of backbone chiral centers.

In some embodiments, the present disclosure provides a chirally controlled oligonucleotide composition comprising oligonucleotides of a particular oligonucleotide type characterized by:

1) a common base sequence and length;
2) a common pattern of backbone linkages; and
3) a common pattern of backbone chiral centers;

which composition is chirally controlled in that it is enriched, relative to a substantially racemic preparation of oligonucleotides having the same base sequence and length, for oligonucleotides of the particular oligonucleotide type.

In some embodiments, the present disclosure provides a chirally controlled oligonucleotide composition comprising oligonucleotides of a particular oligonucleotide type characterized by:

1) a common base sequence and length;
2) a common pattern of backbone linkages; and
3) a common pattern of backbone chiral centers, which composition is a substantially pure preparation of a single oligonucleotide in that at least about 10% of the oligonucleotides in the composition have the common base sequence and length, the common pattern of backbone linkages, and the common pattern of backbone chiral centers.

In some embodiments, the present disclosure provides an oligonucleotide composition comprising a predetermined level of oligonucleotides which comprise one or more wing regions and a common core region, wherein:

each wing region independently has a length of two or more bases, and independently and optionally comprises one or more chiral internucleotidic linkages;

the core region independently has a length of two or more bases, and independently comprises one or more chiral internucleotidic linkages, and the common core region has:

1) a common base sequence and length;
2) a common pattern of backbone linkages; and
3) a common pattern of backbone chiral centers.

In some embodiments, the present disclosure provides an oligonucleotide composition comprising a first plurality of oligonucleotides comprising two wing regions and a core region, wherein:

oligonucleotides of the first plurality have the same base sequence;

each wing region independently has a length of two or more bases, and independently comprises one or more modified internucleotidic linkages and one or more modified sugar moieties;

the core region independently has a length of two or more bases and independently comprises one or more natural phosphate linkages.

In some embodiments, each wing region of provided oligonucleotides independently comprises 3, 4, 5, 6, 7, 8, 9, 10 or more bases. In some embodiments, each wing region independently comprises 3 or more bases. In some embodiments, each wing region independently comprises 4 or more bases. In some embodiments, each wing region independently comprises 5 or more bases. In some embodiments, each wing region independently comprises 6 or more bases. In some embodiments, each wing region independently comprises 7 or more bases. In some embodiments, each sugar moiety in a wing is modified. In some embodiments, a modification is a 2'-modification. In some embodiments, each modification is a 2'-modification. In some embodiments, a modification is 2'-F. In some embodiments, each modification is 2'-F. In some embodiments, a modification is 2'-$OR^1$. In some embodiments, each modification is 2'-$OR^1$. In some embodiments, a modification is 2'-$OR^1$. In some embodiments, each modification is 2'-OMe. In some embodiments, each modification is 2'-OMe. In some embodiments, each modification is 2'-MOE. In some embodiments, each modification is 2'-MOE. In some embodiments, a modification is an LNA sugar modification. In some embodiments, each modification is an LNA sugar modification. In some embodiments, each internucleotidic linkage in a wing is a chiral internucleotidic linkage. In some embodiments, each internucleotidic linkage in a wing is an Sp chiral internucleotidic linkage. In some embodiments, a chiral internucleotidic linkage is a phosphorothioate linkage. In some embodiments, a core region comprises one or more natural phosphate linkages and one or more modified internucleotidic linkages. In some embodiments, a core region comprises one or more natural phosphate linkages and one or more chiral internucleotidic linkages. In some embodiments, a core region comprises one or more natural phosphate linkages and one or more Sp chiral internucleotidic linkages. In some embodiments, a core region comprises one or more natural phosphate linkages and one or more Sp phosphorothioate linkages.

In some embodiments, level of oligonucleotides, such as level of a plurality of oligonucleotides (e.g., a first plurality of oligonucleotides, a reference plurality of oligonucleotides, etc.), in provided compositions is predetermined. For example, as readily appreciated by a personal having ordinary skill in the art, provided chirally controlled oligonucleotide compositions of a plurality of oligonucleotides, e.g., a first plurality of oligonucleotides, comprise a predetermined level of such plurality of oligonucleotides.

In some embodiments, provided oligonucleotides have a base sequence of UCAAGGAAGAUGGCAUUUCU (SEQ ID NO: 54). In some embodiments, provided oligonucleotides have a base sequence comprising UCAAGGAAGAUGGCAUUUCU (SEQ ID NO: 54), and a length of up to 30 bases. In some embodiments, provided oligonucleotides have a base sequence comprising UCAAGGAAGAUGGCAUUUCU (SEQ ID NO: 54), and a length of up to 40 bases. In some embodiments, provided oligonucleotides have a base sequence comprising UCAAGGAAGAUGGCAUUUCU (SEQ ID NO: 54), and a length of up to 50 bases. In some embodiments, provided oligonucleotides have a base sequence comprising at least 15 contiguous bases of UCAAGGAAGAUGGCAUUUCU (SEQ ID NO: 54), and a length of up to 30 bases. In some embodiments, provided oligonucleotides have a base sequence comprising at least 15 contiguous bases of UCAAGGAAGAUGGCAUUUCU (SEQ ID NO: 54), and a length of up to 40 bases. In some embodiments, provided oligonucleotides have a base sequence comprising at least 15 contiguous bases of UCAAGGAAGAUGGCAUUUCU (SEQ ID NO: 54), and a length of up to 50 bases. In some embodiments, provided oligonucleotides have a base sequence comprising a sequence having no more than 5 mismatches from the sequence of bases of UCAAGGAAGAUGGCAUUUCU (SEQ ID NO: 54), and a length of up to 30 bases. In some embodiments, provided oligonucleotides have a base sequence comprising a sequence having no more than 5 mismatches from the sequence of bases of UCAAGGAAGAUGGCAUUUCU (SEQ ID NO: 54), and a length of up to 40 bases. In some embodiments, provided oligonucleotides have a base sequence comprising a sequence having no more than 5 mismatches from the sequence of bases of UCAAGGAAGAUGGCAUUUCU (SEQ ID NO: 54), and a length of up to 50 bases.

In some embodiments, a common base sequence of a plurality of oligonucleotides is UCAAGGAAGAUGG-CAUUUCU (SEQ ID NO: 54). In some embodiments, a common base sequence comprises UCAAGGAAGAUGG-CAUUUCU (SEQ ID NO: 54), and the oligonucleotides have a length of up to 30 bases. In some embodiments, a common base sequence comprises UCAAGGAAGAUGG-CAUUUCU (SEQ ID NO: 54), and the oligonucleotides have a length of up to 40 bases. In some embodiments, a common base sequence comprises UCAAGGAAGAUGG-CAUUUCU (SEQ ID NO: 54), and the oligonucleotides have a length of up to 50 bases. In some embodiments, a common base sequence comprises at least 15 contiguous bases of UCAAGGAAGAUGGCAUUUCU (SEQ ID NO: 54), and the oligonucleotides have a length of up to 30 bases. In some embodiments, a common base sequence comprises at least 15 contiguous bases of UCAAGGAAGAUGG-CAUUUCU (SEQ ID NO: 54), and the oligonucleotides have a length of up to 40 bases. In some embodiments, a common base sequence comprises at least 15 contiguous bases of UCAAGGAAGAUGGCAUUUCU (SEQ ID NO: 54), and the oligonucleotides have a length of up to 50 bases. In some embodiments, a common base sequence comprises a sequence having no more than 5 mismatches from the sequence of bases of UCAAGGAAGAUGGCAUUUCU (SEQ ID NO: 54), and the oligonucleotides have a length of up to 30 bases. In some embodiments, a common base sequence comprises a sequence having no more than 5 mismatches from the sequence of bases of UCAAGGAAGAUGGCAUUUCU (SEQ ID NO: 54), and the oligonucleotides have a length of up to 40 bases. In some embodiments, a common base sequence comprises a sequence having no more than 5 mismatches from the sequence of bases of UCAAGGAAGAUGGCAUUUCU (SEQ ID NO: 54), and the oligonucleotides have a length of up to 50 bases.

In some embodiments, a common base sequence of a plurality of oligonucleotides is UCAAGGAAGAUGG-CAUUUCU (SEQ ID NO: 54), and a common pattern of backbone chiral centers comprises at least one chirally controlled center. In some embodiments, a common base sequence comprises UCAAGGAAGAUGGCAUUUCU (SEQ ID NO: 54), the oligonucleotides have a length of up to 30 bases, and a common pattern of backbone chiral centers comprises at least one chirally controlled center. In some embodiments, a common base sequence comprises UCAAGGAAGAUGGCAUUUCU (SEQ ID NO: 54), and the oligonucleotides have a length of up to 40 bases, and a common pattern of backbone chiral centers comprises at least one chirally controlled center. In some embodiments, a common base sequence comprises UCAAGGAAGAUGG-CAUUUCU (SEQ ID NO: 54), the oligonucleotides have a length of up to 50 bases, and a common pattern of backbone chiral centers comprises at least one chirally controlled center. In some embodiments, a common base sequence comprises at least 15 contiguous bases of UCAAGGAAGAUGGCAUUUCU (SEQ ID NO: 54), the oligonucleotides have a length of up to 30 bases, and a common pattern of backbone chiral centers comprises at least one chirally controlled center. In some embodiments, a common base sequence comprises at least 15 contiguous bases of UCAAGGAAGAUGGCAUUUCU (SEQ ID NO: 54), the oligonucleotides have a length of up to 40 bases, and a common pattern of backbone chiral centers comprises at least one chirally controlled center. In some embodiments, a common base sequence comprises at least 15 contiguous bases of UCAAGGAAGAUGGCAUUUCU (SEQ ID NO: 54), the oligonucleotides have a length of up to 50 bases, and a common pattern of backbone chiral centers comprises at least one chirally controlled center. In some embodiments, a common base sequence comprises a sequence having no more than 5 mismatches from the sequence of bases of UCAAGGAAGAUGGCAUUUCU (SEQ ID NO: 54), the oligonucleotides have a length of up to 30 bases, and a common pattern of backbone chiral centers comprises at least one chirally controlled center. In some embodiments, a common base sequence comprises a sequence having no more than 5 mismatches from the sequence of bases of UCAAGGAAGAUGGCAUUUCU (SEQ ID NO: 54), the oligonucleotides have a length of up to 40 bases, and a common pattern of backbone chiral centers comprises at least one chirally controlled center. In some embodiments, a common base sequence comprises a sequence having no more than 5 mismatches from the sequence of bases of UCAAGGAAGAUGGCAUUUCU (SEQ ID NO: 54), the oligonucleotides have a length of up to 50 bases, and a common pattern of backbone chiral centers comprises at least one chirally controlled center.

In some embodiments, a common base sequence is UCAAGGAAGAUGGCAUUUCU (SEQ ID NO: 54), and a common pattern of backbone chiral centers comprises at least one chirally controlled center which is a phosphorothioate in the Sp configuration. In some embodiments, a common base sequence comprises UCAAGGAAGAUGG-CAUUUCU (SEQ ID NO: 54), the oligonucleotides have a length of up to 30 bases, and a common pattern of backbone chiral centers comprises at least one chirally controlled center which is a phosphorothioate in the Sp configuration. In some embodiments, a common base sequence comprises UCAAGGAAGAUGGCAUUUCU (SEQ ID NO: 54), and the oligonucleotides have a length of up to 40 bases, and a common pattern of backbone chiral centers comprises at least one chirally controlled center which is a phosphorothioate in the Sp configuration. In some embodiments, a common base sequence comprises UCAAGGAAGAUGG-CAUUUCU (SEQ ID NO: 54), the oligonucleotides have a length of up to 50 bases, and a common pattern of backbone chiral centers comprises at least one chirally controlled center which is a phosphorothioate in the Sp configuration. In some embodiments, a common base sequence comprises at least 15 contiguous bases of UCAAGGAAGAUGG-CAUUUCU (SEQ ID NO: 54), the oligonucleotides have a length of up to 30 bases, and a common pattern of backbone chiral centers comprises at least one chirally controlled center which is a phosphorothioate in the Sp configuration. In some embodiments, a common base sequence comprises at least 15 contiguous bases of UCAAGGAAGAUGG-CAUUUCU (SEQ ID NO: 54), the oligonucleotides have a length of up to 40 bases, and a common pattern of backbone chiral centers comprises at least one chirally controlled center which is a phosphorothioate in the Sp configuration. In some embodiments, a common base sequence comprises at least 15 contiguous bases of UCAAGGAAGAUGG-CAUUUCU (SEQ ID NO: 54), the oligonucleotides have a length of up to 50 bases, and a common pattern of backbone chiral centers comprises at least one chirally controlled center which is a phosphorothioate in the Sp configuration. In some embodiments, a common base sequence comprises a sequence having no more than 5 mismatches from the sequence of bases of UCAAGGAAGAUGGCAUUUCU (SEQ ID NO: 54), the oligonucleotides have a length of up to 30 bases, and a common pattern of backbone chiral centers comprises at least one chirally controlled center which is a phosphorothioate in the Sp configuration. In some embodiments, a common base sequence comprises a sequence having no more than 5 mismatches from the sequence of bases of UCAAGGAAGAUGGCAUUUCU (SEQ ID NO: 54), the oligonucleotides have a length of up to 40 bases, and a common pattern of backbone chiral centers comprises at least one chirally controlled center which is a phosphorothioate in the Sp configuration. In some embodiments, a common base sequence comprises a sequence having no more than 5 mismatches from the sequence of bases of UCAAGGAAGAUGGCAUUUCU (SEQ ID NO: 54), the oligonucleotides have a length of up to 50 bases, and a common pattern of backbone chiral centers comprises at least one chirally controlled center which is a phosphorothioate in the Sp configuration.

In some embodiments, a common base sequence is UCAAGGAAGAUGGCAUUUCU (SEQ ID NO: 54), and a common pattern of backbone chiral centers comprises at least three chirally controlled centers. In some embodiments, a common base sequence comprises UCAAGGAAGAUGGCAUUUCU (SEQ ID NO: 54), the oligonucleotides have a length of up to 30 bases, and a common pattern of backbone chiral centers comprises at least three chirally controlled centers. In some embodiments, a common base sequence comprises UCAAGGAAGAUGGCAUUUCU (SEQ ID NO: 54), and the oligonucleotides have a length of up to 40 bases, and a common pattern of backbone chiral centers comprises at least three chirally controlled centers. In some embodiments, a common base sequence comprises UCAAGGAAGAUGGCAUUUCU (SEQ ID NO: 54), the oligonucleotides have a length of up to 50 bases, and a common pattern of backbone chiral centers comprises at least three chirally controlled centers. In some embodiments, a common base sequence comprises at least 15 contiguous bases of UCAAGGAAGAUGGCAUUUCU (SEQ ID NO: 54), the oligonucleotides have a length of up to 30 bases, and a common pattern of backbone chiral centers comprises at least three chirally controlled centers. In some embodiments, a common base sequence comprises at least 15 contiguous bases of UCAAGGAAGAUGGCAUUUCU (SEQ ID NO: 54), the oligonucleotides have a length of up to 40 bases, and a common pattern of backbone chiral centers comprises at least three chirally controlled centers. In some embodiments, a common base sequence comprises at least 15 contiguous bases of UCAAGGAAGAUGGCAUUUCU (SEQ ID NO: 54), the oligonucleotides have a length of up to 50 bases, and a common pattern of backbone chiral centers comprises at least three chirally controlled centers. In some embodiments, a common base sequence comprises a sequence having no more than 5 mismatches from the sequence of bases of UCAAGGAAGAUGGCAUUUCU (SEQ ID NO: 54), the oligonucleotides have a length of up to 30 bases, and a common pattern of backbone chiral centers comprises at least three chirally controlled centers. In some embodiments, a common base sequence comprises a sequence having no more than 5 mismatches from the sequence of bases of UCAAGGAAGAUGGCAUUUCU (SEQ ID NO: 54), the oligonucleotides have a length of up to 40 bases, and a common pattern of backbone chiral centers comprises at least three chirally controlled centers. In some embodiments, a common base sequence comprises a sequence having no more than 5 mismatches from the sequence of bases of UCAAGGAAGAUGGCAUUUCU (SEQ ID NO: 54), the oligonucleotides have a length of up to 50 bases, and a common pattern of backbone chiral centers comprises at least three chirally controlled centers.

In some embodiments, a common base sequence is UCAAGGAAGAUGGCAUUUCU (SEQ ID NO: 54), and a common pattern of backbone chiral centers comprises at least five chirally controlled centers which are each a phosphorothioate in the Sp configuration. In some embodiments, a common base sequence comprises UCAAGGAAGAUGGCAUUUCU (SEQ ID NO: 54), the oligonucleotides have a length of up to 30 bases, and a common pattern of backbone chiral centers comprises at least five chirally controlled centers which are each a phosphorothioate in the Sp configuration. In some embodiments, a common base sequence comprises UCAAGGAAGAUGGCAUUUCU (SEQ ID NO: 54), and the oligonucleotides have a length of up to 40 bases, and a common pattern of backbone chiral centers comprises at least five chirally controlled centers which are each a phosphorothioate in the Sp configuration. In some embodiments, a common base sequence comprises UCAAGGAAGAUGGCAUUUCU (SEQ ID NO: 54), the oligonucleotides have a length of up to 50 bases, and a common pattern of backbone chiral centers comprises at least five chirally controlled centers which are each a phosphorothioate in the Sp configuration. In some embodiments, a common base sequence comprises at least 15 contiguous bases of UCAAGGAAGAUGGCAUUUCU (SEQ ID NO: 54), the oligonucleotides have a length of up to 30 bases, and a common pattern of backbone chiral centers comprises at least five chirally controlled centers which are each a phosphorothioate in the Sp configuration. In some embodiments, a common base sequence comprises at least 15 contiguous bases of UCAAGGAAGAUGGCAUUUCU (SEQ ID NO: 54), the oligonucleotides have a length of up to 40 bases, and a common pattern of backbone chiral centers comprises at least five chirally controlled centers which are each a phosphorothioate in the Sp configuration. In some embodiments, a common base sequence comprises at least 15 contiguous bases of UCAAGGAAGAUGGCAUUUCU (SEQ ID NO: 54), the oligonucleotides have a length of up to 50 bases, and a common pattern of backbone chiral centers comprises at least five chirally controlled centers which are each a phosphorothioate in the Sp configuration. In some embodiments, a common base sequence comprises a sequence having no more than 5 mismatches from the sequence of bases of UCAAGGAAGAUGGCAUUUCU (SEQ ID NO: 54), the oligonucleotides have a length of up to 30 bases, and a common pattern of backbone chiral centers comprises at least five chirally controlled centers which are each a phosphorothioate in the Sp configuration. In some embodiments, a common base sequence comprises a sequence having no more than 5 mismatches from the sequence of bases of UCAAGGAAGAUGGCAUUUCU (SEQ ID NO: 54), the oligonucleotides have a length of up to 40 bases, and a common pattern of backbone chiral centers comprises at least five chirally controlled centers which are each a phosphorothioate in the Sp configuration. In some embodiments, a common base sequence comprises a sequence having no more than 5 mismatches from the sequence of bases of UCAAGGAAGAUGGCAUUUCU (SEQ ID NO: 54), the oligonucleotides have a length of up to 50 bases, and a common pattern of backbone chiral centers comprises at least five chirally controlled centers which are each a phosphorothioate in the Sp configuration. In some embodiments, a mismatch is a difference between the base sequence or length when two sequences are maximally aligned and compared. As a non-limiting example, a mismatch is counted if a difference exists between the base at a particular location in one sequence and the base at the corresponding position in another sequence. Thus, a mismatch is counted, for example, if a position in one sequence has a particular base (e.g., A), and the corresponding position on the other sequence has a different base (e.g., G, C or U). A mismatch is also counted, e.g., if a position in one sequence has a base (e.g., A), and the corresponding position on the other sequence has no base (e.g., that position is an abasic nucleotide which comprises a phosphate-sugar backbone but no base) or that position is skipped. A single-stranded nick in either sequence (or in the sense or antisense strand) may not be counted as mismatch, for example, no mismatch would be counted if one sequence comprises the sequence 5'-AG-3', but the other sequence comprises the sequence 5'-AG-3' with a single-stranded nick between the A and the G. A base modification is generally not considered a mismatch, for example, if one sequence comprises a C, and the other sequence comprises a modified C (e.g., with a 2-modification) at the same position, no mismatch may be counted.

In some embodiments, a common pattern of backbone chiral centers comprises SSS, SSSS, SSSSS, SSSSSS, SSSSSSS, SOS, SSOSS, SSSOSSS, SSSSOSSSS, SSSSSOSSSSS, SSSSSSOSSSSSS, SSSSSSSOSSSSSSS, SSSSSSSSOSSSSSSSS, SSSSSSSSSOSSSSSSSSS, SOSOSOSOS, SSOSOSOSOSS, SSSOSOSOSOSSS, SSSSOSOSOSOSSSS, SSSSSOSOSOSOSSSSS, SSSSSSOSOSOSOSSSSSS, SOSOSSOOS, SSOSOSSOOSS, SSSOSOSSOOSSS, SSSSOSOSSOOSSSS, SSSSSOSOSSOOSSSSS, SSSSSSOSOSSOOSSSSSS, SOSOOSOOS, SSOSOOSOOSS, SSSOSOOSOOSSS, SSSSOSOOSOOSSSS, SSSSSOSOOSOOSSSSS, SSSSSSOSOOSOOSSSSSS, SOSOSSOOS, SSOSOSSOOSO, SSSOSOSSOOSOS, SSSSOSOSSOOSOSS, SSSSSOSOSSOOSOSSS, SSSSSSOSOSSOOSOSSSS, SOSOOSOOSO, SSOSOOSOOSOS, SSSOSOOSOOSOS, SSSSOSOOSOOSOSS, SSSSSOSOOSOOSOSSS, SSSSSSOSOOSOOSOSSSS, SSOSOSSOO, SSSOSOSSOOS, SSSSOSOSSOOS, SSSSSOSOSSOOSS, SSSSSSOSOSSOOSSS, OSSSSSSOSOSSOOSSS, OOSSSSSSOSOSSOOS, OOSSSSSSOSOSSOOSS, OOSSSSSSOSOSSOOSSS, OOSSSSSSOSOSSOOSSSS, OOSSSSSSOSOSSOOSSSSS, or OOSSSSSSOSOSSOOSSSSSS, wherein O is a non-chiral center and S is a chiral center in an Sp configuration. In some embodiments, a common pattern of backbone chiral centers is selected from: SSS, SSSS, SSSSS, SSSSSS, SSSSSSS, SOS, SSOSS, SSSOSSS, SSSSOSSSS, SSSSSOSSSSS, SSSSSSOSSSSSS, SSSSSSSOSSSSSSS, SSSSSSSSOSSSSSSSS, SOSOSOSOS, SSOSOSOSOSS, SSSOSOSOSOSSS, SSSSOSOSOSOSSSS, SSSSSOSOSOSOSSSSS, SSSSSSOSOSOSOSSSSSS, SOSOSSOOS, SSOSOSSOOSS, SSSOSOSSOOSSS, SSSSOSOSSOOSSSS, SSSSSOSOSSOOSSSSS, SSSSSSOSOSSOOSSSSSS, SOSOOSOOS, SSOSOOSOOSS, SSSOSOOSOOSSS, SSSSOSOOSOOSSSS, SSSSSOSOOSOOSSSSS, SSSSSSOSOOSOOSSSSSS, SOSOSSOOS, SSOSOSSOOSO, SSSOSOSSOOSOS, SSSSOSOSSOOSOSS, SSSSSOSOSSOOSOSSS, SSSSSSOSOSSOOSOSSSS, SOSOOSOOSO, SSOSOOSOOSOS, SSSOSOOSOOSOS, SSSSOSOOSOOSOSS, SSSSSOSOOSOOSOSSS, SSSSSSOSOOSOOSOSSSS, SSOSOSSOO, SSSOSOSSOOS, SSSSOSOSSOOS, SSSSSOSOSSOOSS, SSSSSSOSOSSOOSSS, OSSSSSSOSOSSOOSSS, OOSSSSSSOSOSSOOS, OOSSSSSSOSOSSOOSS, OOSSSSSSOSOSSOOSSS, OOSSSSSSOSOSSOOSSSS, OOSSSSSSOSOSSOOSSSSS, and OOSSSSSSOSOSSOOSSSSSS, wherein O is a non-chiral center and S is a chiral center in an Sp configuration. In some embodiments, the non-chiral center is phosphodiester (a natural phosphate linkage). In some embodiments, the chiral center in an Sp configuration is an Sp phosphorothioate linkage.

In some embodiments, a common pattern of backbone linkages comprises at least 10 modified internucleotidic linkages. In some embodiments, a common pattern of backbone linkages comprises at least 11 modified internucleotidic linkages. In some embodiments, a common pattern of backbone linkages comprises at least 12 modified internucleotidic linkages. In some embodiments, a common pattern of backbone linkages comprises at least 13 modified internucleotidic linkages. In some embodiments, a common pattern of backbone linkages comprises at least 14 modified internucleotidic linkages. In some embodiments, a common pattern of backbone linkages comprises at least 15 modified internucleotidic linkages. In some embodiments, a common pattern of backbone linkages comprises at least 16 modified internucleotidic linkages. In some embodiments, a common pattern of backbone linkages comprises at least 17 modified internucleotidic linkages. In some embodiments, a common pattern of backbone linkages comprises at least 18 modified internucleotidic linkages. In some embodiments, a common pattern of backbone linkages comprises at least 19 modified internucleotidic linkages. In some embodiments, a common pattern of backbone linkages comprises no more than 19 modified internucleotidic linkages. In some embodiments, a common pattern of backbone linkages comprises no more than 18 modified internucleotidic linkages. In some embodiments, a common pattern of backbone linkages comprises no more than 17 modified internucleotidic linkages. In some embodiments, a common pattern of backbone linkages comprises no more than 16 modified internucleotidic linkages. In some embodiments, a common pattern of backbone linkages comprises no more than 15 modified internucleotidic linkages. In some embodiments, a common pattern of backbone linkages comprises no more than 14 modified internucleotidic linkages. In some embodiments, a common pattern of backbone linkages comprises 14 to 18 modified internucleotidic linkages. In some embodiments, a common pattern of backbone linkages comprises 13 to 19 modified internucleotidic linkages. In some embodiments, a common pattern of backbone linkages comprises 12 to 20 modified internucleotidic linkages. In some embodiments, a common pattern of backbone linkages comprises 11 to 21 modified internucleotidic linkages. In some embodiments, a common pattern of backbone linkages comprises 0 phosphodiesters. In some embodiments, a common pattern of backbone linkages comprises 1 phosphodiester. In some embodiments, a common pattern of backbone linkages comprises 2 phosphodiesters. In some embodiments, a common pattern of backbone linkages comprises 3 phosphodiesters. In some embodiments, a common pattern of backbone linkages comprises 4 phosphodiesters. In some embodiments, a common pattern of backbone linkages comprises 5 phosphodiesters. In some embodiments, a common pattern of backbone linkages comprises 6 phosphodiesters. In some embodiments, a common pattern of backbone linkages comprises 7 phosphodiesters. In some embodiments, a common pattern of backbone linkages comprises 0 to 7 phosphodiesters. In some embodiments, a common pattern of backbone linkages comprises 1 to 6 phosphodiesters. In some embodiments, a common pattern of backbone linkages comprises 2 to 5 phosphodiesters. In some embodiments, a common pattern of backbone linkages comprises 3 to 4 phosphodiesters. In some embodiments, a common pattern of backbone linkages comprises 1 to 6 phosphodiesters and 13 to 19 modified internucleotidic linkages. In some embodiments, the phosphodiesters are optionally contiguous or not contiguous. In some embodiments, the modified internucleotidic linkages are optionally contiguous or not contiguous.

In some embodiments, a common pattern of backbone linkages comprises at least 10 phosphorothioate linkages. In some embodiments, a common pattern of backbone linkages comprises at least 11 phosphorothioate linkages. In some embodiments, a common pattern of backbone linkages comprises at least 12 phosphorothioate linkages. In some embodiments, a common pattern of backbone linkages comprises at least 13 phosphorothioate linkages. In some embodiments, a common pattern of backbone linkages comprises at least 14 phosphorothioate linkages. In some embodiments, a common pattern of backbone linkages comprises at least 15 phosphorothioate linkages. In some embodiments, a common pattern of backbone linkages comprises at least 16 phosphorothioate linkages. In some embodiments, a common pattern of backbone linkages comprises at least 17 phosphorothioate linkages. In some embodiments, a common pattern of backbone linkages comprises at least 18 phosphorothioate linkages. In some embodiments, a common pattern of backbone linkages comprises at least 19 phosphorothioate linkages. In some embodiments, a common pattern of backbone linkages comprises no more than 19 phosphorothioate linkages. In some embodiments, a common pattern of backbone linkages comprises no more than 18 phosphorothioate linkages. In some embodiments, a common pattern of backbone linkages comprises no more than 17 phosphorothioate linkages. In some embodiments, a common pattern of backbone linkages comprises no more than 16 phosphorothioate linkages. In some embodiments, a common pattern of backbone linkages comprises no more than 15 phosphorothioate linkages. In some embodiments, a common pattern of backbone linkages comprises no more than 14 phosphorothioate linkages. In some embodiments, a common pattern of backbone linkages comprises 14 to 18 phosphorothioate linkages. In some embodiments, a common pattern of backbone linkages comprises 13 to 19 phosphorothioate linkages. In some embodiments, a common pattern of backbone linkages comprises 12 to 20 phosphorothioate linkages. In some embodiments, a common pattern of backbone linkages comprises 11 to 21 phosphorothioate linkages. In some embodiments, a common pattern of backbone linkages comprises 0 phosphodiesters. In some embodiments, a common pattern of backbone linkages comprises 1 phosphodiester. In some embodiments, a common pattern of backbone linkages comprises 2 phosphodiesters. In some embodiments, a common pattern of backbone linkages comprises 3 phosphodiesters. In some embodiments, a common pattern of backbone linkages comprises 4 phosphodiesters. In some embodiments, a common pattern of backbone linkages comprises 5 phosphodiesters. In some embodiments, a common pattern of backbone linkages comprises 6 phosphodiesters. In some embodiments, a common pattern of backbone linkages comprises 7 phosphodiesters. In some embodiments, a common pattern of backbone linkages comprises 0 to 7 phosphodiesters. In some embodiments, a common pattern of backbone linkages comprises 1 to 6 phosphodiesters. In some embodiments, a common pattern of backbone linkages comprises 2 to 5 phosphodiesters. In some embodiments, a common pattern of backbone linkages comprises 3 to 4 phosphodiesters. In some embodiments, a common pattern of backbone linkages comprises 1 to 6 phosphodiesters and 13 to 19 phosphorothioate linkages. In some embodiments, the phosphodiesters are optionally contiguous or not contiguous. In some embodiments, the phosphorothioate linkages are optionally contiguous or not contiguous.

In some embodiments, a common pattern of backbone chiral centers comprises at least 5 internucleotidic linkages in the Sp configuration. In some embodiments, a common pattern of backbone chiral centers comprises at least 6 internucleotidic linkages in the Sp configuration. In some embodiments, a common pattern of backbone chiral centers comprises at least 7 internucleotidic linkages in the Sp configuration. In some embodiments, a common pattern of backbone chiral centers comprises at least 8 internucleotidic linkages in the Sp configuration. In some embodiments, a common pattern of backbone chiral centers comprises at least 9 internucleotidic linkages in the Sp configuration. In some embodiments, a common pattern of backbone chiral centers comprises at least 10 internucleotidic linkages in the Sp configuration. In some embodiments, a common pattern of backbone chiral centers comprises at least 11 internucleotidic linkages in the Sp configuration. In some embodiments, a common pattern of backbone chiral centers comprises at least 12 internucleotidic linkages in the Sp configuration. In some embodiments, a common pattern of backbone chiral centers comprises at least 13 internucleotidic linkages in the Sp configuration. In some embodiments, a common pattern of backbone chiral centers comprises at least 14 internucleotidic linkages in the Sp configuration. In some embodiments, a common pattern of backbone chiral centers comprises at least 15 internucleotidic linkages in the Sp configuration. In some embodiments, a common pattern of backbone chiral centers comprises at least 16 internucleotidic linkages in the Sp configuration. In some embodiments, a common pattern of backbone chiral centers comprises at least 17 internucleotidic linkages in the Sp configuration. In some embodiments, a common pattern of backbone chiral centers comprises at least 18 internucleotidic linkages in the Sp configuration. In some embodiments, a common pattern of backbone chiral centers comprises at least 19 internucleotidic linkages in the Sp configuration. In some embodiments, a common pattern of backbone chiral centers comprises no more than 8 internucleotidic linkages in the Rp configuration. In some embodiments, a common pattern of backbone chiral centers comprises no more than 7 internucleotidic linkages in the Rp configuration. In some embodiments, a common pattern of backbone chiral centers comprises no more than 6 internucleotidic linkages in the Rp configuration. In some embodiments, a common pattern of backbone chiral centers comprises no more than 5 internucleotidic linkages in the Rp configuration. In some embodiments, a common pattern of backbone chiral centers comprises no more than 4 internucleotidic linkages in the Rp configuration. In some embodiments, a common pattern of backbone chiral centers comprises no more than 3 internucleotidic linkages in the Rp configuration. In some embodiments, a common pattern of backbone chiral centers comprises no more than 2 internucleotidic linkages in the Rp configuration. In some embodiments, a common pattern of backbone chiral centers comprises no more than 1 internucleotidic linkages in the Rp configuration. In some embodiments, a common pattern of backbone chiral centers comprises no more than 8 internucleotidic linkages which are not chiral (as a non-limiting example, a phosphodiester). In some embodiments, a common pattern of backbone chiral centers comprises no more than 7 internucleotidic linkages which are not chiral. In some embodiments, a common pattern of backbone chiral centers comprises no more than 6 internucleotidic linkages which are not chiral. In some embodiments, a common pattern of backbone chiral centers comprises no more than 5 internucleotidic linkages which are not chiral. In some embodiments, a common pattern of backbone chiral centers comprises no more than 4 internucleotidic linkages which are not chiral. In some embodiments, a common pattern of backbone chiral centers comprises no more than 3 internucleotidic linkages which are not chiral. In some embodiments, a common pattern of backbone chiral centers comprises no more than 2 internucleotidic linkages which are not chiral. In some embodiments, a common pattern of backbone chiral centers comprises no more than 1 internucleotidic linkages which are not chiral. In some embodiments, a common pattern of backbone chiral centers comprises at least 10 internucleotidic linkages in the Sp configuration, and no more than 8 internucleotidic linkages which are not chiral. In some embodiments, a common pattern of backbone chiral centers comprises at least 11 internucleotidic linkages in the Sp configuration, and no more than 7 internucleotidic linkages which are not chiral. In some embodiments, a common pattern of backbone chiral centers comprises at least 12 internucleotidic linkages in the Sp configuration, and no more than 6 internucleotidic linkages which are not chiral. In some embodiments, a common pattern of backbone chiral centers comprises at least 13 internucleotidic linkages in the Sp configuration, and no more than 6 internucleotidic linkages which are not chiral. In some embodiments, a common pattern of backbone chiral centers comprises at least 14 internucleotidic linkages in the Sp configuration, and no more than 5 internucleotidic linkages which are not chiral. In some embodiments, a common pattern of backbone chiral centers comprises at least 15 internucleotidic linkages in the Sp configuration, and no more than 4 internucleotidic linkages which are not chiral. In some embodiments, the internucleotidic linkages in the Sp configuration are optionally contiguous or not contiguous. In some embodiments, the internucleotidic linkages in the Rp configuration are optionally contiguous or not contiguous. In some embodiments, the internucleotidic linkages which are not chiral are optionally contiguous or not contiguous.

A wing and core can be defined by any structural elements. In some embodiments, a wing and core is defined by nucleoside modifications, wherein a wing comprises a nucleoside modification that the core region does not have. In some embodiments, oligonucleotides in provided compositions have a wing-core structure of nucleoside modification. In some embodiments, oligonucleotides in provided compositions have a core-wing structure of nucleoside modification. In some embodiments, oligonucleotides in provided compositions have a wing-core-wing structure of nucleoside modification. In some embodiments, a wing and core is defined by modifications of the sugar moieties. In some embodiments, a wing and core is defined by modifications of the base moieties. In some embodiments, each sugar moiety in the wing region has the same 2'-modification which is not found in the core region. In some embodiments, each sugar moiety in the wing region has the same 2'-modification which is different than any sugar modifications in the core region. In some embodiments, each sugar moiety in the wing region has the same 2'-modification, and the core region has no 2'-modifications. In some embodiments, when two or more wings are present, each sugar moiety in a wing region has the same 2'-modification, yet the common 2'-modification in a first wing region can either be the same as or different from the common 2'-modification in a second wing region. In some embodiments, a wing and core is defined by pattern of backbone internucleotidic linkages. In some embodiments, a wing comprises a type of internucleotidic linkage, and/or a pattern of internucleotidic linkages, that are not found in a core. In some embodiments, a wing region comprises both a modified internucleotidic linkage and a natural phosphate linkage. In some embodiments, the internucleotidic linkage at the 5'-end of a wing to the 5'-end of the core region is a modified internucleotidic linkage. In some embodiments, the internucleotidic linkage at the 3'-end of a wing to the 3'-end of the core region is a modified internucleotidic linkage. In some embodiments, a modified internucleotidic linkage is a chiral internucleotidic linkage.

In some embodiments, a wing comprises at least 3 2'-F modifications. In some embodiments, a wing comprises at least 4 2'-F modifications. In some embodiments, a wing comprises at least 5 2'-F modifications. In some embodiments, a wing comprises at least 6 2'-F modifications. In some embodiments, a wing comprises at least 3 consecutive 2'-F modifications. In some embodiments, a wing comprises at least 4 consecutive 2'-F modifications. In some embodiments, a wing comprises at least 5 consecutive 2'-F modifications. In some embodiments, a wing comprises at least 6 consecutive 2'-F modifications. In some embodiments, the internucleotidic linkage of each nucleotide unit having one of the consecutive 2'-F modifications is a modified internucleotidic linkage. In some embodiments, the internucleotidic linkage of each nucleotide unit having one of the consecutive 2'-F modifications is independently an Sp chiral internucleotidic linkage. In some embodiments, the internucleotidic linkage of each nucleotide unit having one of the consecutive 2'-F modifications is an Sp phosphorothioate linkage. In some embodiments, a core comprising two or more of any of: a 2'-F modification, a 2'-$OR^1$ modification, or 2'-OH. In some embodiments, a core comprising two or more of any of: a 2'-F modification, a 2'-OMe modification, or 2'-OH. In some embodiments, a core comprises at least 1 2'-OMe modification. In some embodiments, a core comprises at least 2 2'-OMe modifications. In some embodiments, a core comprises at least 3 2'-OMe modifications. In some embodiments, a core comprises at least 2 2'-OMe modifications. In some embodiments, a core comprises at least 4 2'-OMe modifications. In some embodiments, a core comprises at least 1 2'-F modification. In some embodiments, a core comprises at least 2 2'-F modifications. In some embodiments, a core comprises at least 3 2'-F modifications. In some embodiments, a core comprises at least 2 2'-F modifications. In some embodiments, a core comprises at least 4 2'-F modifications. In some embodiments, a core comprises at least 1 2'-F modification and at least 1 2'-OMe modification. In some embodiments, a core comprises at least 1 2'-F modification and at least 2 2'-OMe modifications. In some embodiments, a core comprises at least 2 2'-F modifications and at least 1 2'-OMe modification. In some embodiments, a core comprises at least 2 2'-F modifications and at least 2 2'-OMe modifications. In some embodiments, the 2'-F modifications in the core and/or wing are contiguous or non-contiguous. In some embodiments, the 2'-OMe modifications in the core and/or wing are contiguous or non-contiguous. In some embodiments, the 2'-OH in the core and/or wing are contiguous or non-contiguous. In some embodiments, a core comprises one or more natural phosphate linkages.

In some embodiments, each wing comprises at least one chiral internucleotidic linkage and at least one natural phosphate linkage. In some embodiments, each wing comprises at least one modified sugar moiety. In some embodiments, each wing sugar moiety is modified. In some embodiments, a wing sugar moiety is modified by a modification that is absent from the core region. In some embodiments, a wing region only has modified internucleotidic linkages at one or both of its ends. In some embodiments, a wing region only has a modified internucleotidic linkage at its 5'-end. In some embodiments, a wing region only has a modified internucleotidic linkage at its 3'-end. In some embodiments, a wing region only has modified internucleotidic linkages at its 5'- and 3'-ends. In some embodiments, a wing is to the 5'-end of a core, and the wing only has a modified internucleotidic linkage at its 5'-end. In some embodiments, a wing is to the 5'-end of a core, and the wing only has a modified internucleotidic linkage at its 3'-end. In some embodiments, a wing is to the 5'-end of a core, and the wing only has modified internucleotidic linkages at both its 5'- and 3'-ends. In some embodiments, a wing is to the 3'-end of a core, and the wing only has a modified internucleotidic linkage at its 5'-end. In some embodiments, a wing is to the 3'-end of a core, and the wing only has a modified internucleotidic linkage at its 3'-end. In some embodiments, a wing is to the 3'-end of a core, and the wing only has modified internucleotidic linkages at both its 5'- and 3'-ends.

In some embodiments, each internucleotidic linkage within a core region is modified. In some embodiments, each internucleotidic linkage within a core region is chiral. In some embodiments, a core region comprises a pattern of backbone chiral centers of (Sp)m(Rp)n, (Rp)n(Sp)m, (Np)t(Rp)n(Sp)m, or (Sp)t(Rp)n(Sp)m. In some embodiments, the pattern of backbone chiral centers of a core region is (Sp)m(Rp)n, (Rp)n(Sp)m, (Np)t(Rp)n(Sp)m, or (Sp)t(Rp)n(Sp)m. In some embodiments, a core region comprises a pattern of backbone chiral centers of (Rp)n(Sp)m, (Np)t(Rp)n(Sp)m, or (Sp)t(Rp)n(Sp)m, wherein m>2. In some embodiments, the pattern of backbone chiral centers of a core region is (Sp)m(Rp)n, (Rp)n(Sp)m, (Np)t(Rp)n(Sp)m, or (Sp)t(Rp)n(Sp)m, wherein m>2. Among other things, in some embodiments such patterns can provide or enhance controlled cleavage of a target sequence, e.g., an RNA sequence.

In some embodiments, a wing comprises at least 4 phosphorothioates (phosphorothioate linkages). In some embodiments, a wing comprises at least 5 phosphorothioates. In some embodiments, a wing comprises at least 6 phosphorothioates. In some embodiments, a core comprises at least 2 phosphorothioates. In some embodiments, a core comprises at least 3 phosphorothioates. In some embodiments, a core comprises at least 4 phosphorothioates. In some embodiments, a core comprises at least 5 phosphorothioates. In some embodiments, a core comprises at least 6 phosphorothioates. In some embodiments, a core comprises at least 2 phosphodiesters (natural phosphate linkages). In some embodiments, a core comprises at least 3 phosphodiesters. In some embodiments, a core comprises at least 4 phosphodiesters. In some embodiments, a core comprises at least 5 phosphodiesters. In some embodiments, a core comprises at least 6 phosphodiesters. In some embodiments, a core comprises at least 1 phosphodiester and at least 1 phosphorothioate. In some embodiments, a core comprises at least 1 phosphodiesters and at least 2 phosphorothioates. In some embodiments, a core comprises at least 2 phosphodiesters and at least 1 phosphorothioates. In some embodiments, a core comprises at least 2 phosphodiesters and at least 2 phosphorothioates. In some embodiments, a core comprises at least 2 phosphodiesters and at least 3 phosphorothioates. In some embodiments, a core comprises at least 3 phosphodiesters and at least 2 phosphorothioates. In some embodiments, a core comprises at least 3 phosphodiesters and at least 3 phosphorothioates. In some embodiments, the phosphodiesters in the core and/or one or both wings are optionally contiguous or not contiguous. In some embodiments, the phosphorothioates in the core and/or one or both wings are optionally contiguous or not contiguous.

In some embodiments, oligonucleotides in provided compositions have a common pattern of backbone phosphorus modifications. In some embodiments, a provided composition is an oligonucleotide composition that is chirally controlled in that the composition contains a predetermined level of oligonucleotides of an individual oligonucleotide type, wherein an oligonucleotide type is defined by:

1) base sequence;
2) pattern of backbone linkages;
3) pattern of backbone chiral centers; and
4) pattern of backbone phosphorus modifications.

As noted above and understood in the art, in some embodiments, base sequence of an oligonucleotide may refer to the identity and/or modification status of nucleoside residues (e.g., of sugar and/or base components, relative to standard naturally occurring nucleotides such as adenine, cytosine, guanosine, thymine, and uracil) in the oligonucleotide and/or to the hybridization character (i.e., the ability to hybridize with particular complementary residues) of such residues.

In some embodiments, a particular oligonucleotide type may be defined by 1A) base identity;
1B) pattern of base modification;
1C) pattern of sugar modification;
2) pattern of backbone linkages;
3) pattern of backbone chiral centers; and
4) pattern of backbone phosphorus modifications.

Thus, in some embodiments, oligonucleotides of a particular type may share identical bases but differ in their pattern of base modifications and/or sugar modifications. In some embodiments, oligonucleotides of a particular type may share identical bases and pattern of base modifications (including, e.g., absence of base modification), but differ in pattern of sugar modifications.

In some embodiments, oligonucleotides of a particular type are chemically identical in that they have the same base sequence (including length), the same pattern of chemical modifications to sugar and base moieties, the same pattern of backbone linkages (e.g., pattern of natural phosphate linkages, phosphorothioate linkages, phosphorothioate triester linkages, and combinations thereof), the same pattern of backbone chiral centers (e.g., pattern of stereochemistry (Rp/Sp) of chiral internucleotidic linkages), and the same pattern of backbone phosphorus modifications (e.g., pattern of modifications on the internucleotidic phosphorus atom, such as $—S^-$, and $-L-R^1$ of formula I).

In some embodiments, the present disclosure provides chirally controlled oligonucleotide compositions of oligonucleotides comprising multiple (e.g., more than 5, 6, 7, 8, 9, or 10) internucleotidic linkages, and particularly for oligonucleotides comprising multiple (e.g., more than 5, 6, 7, 8, 9, or 10) chiral internucleotidic linkages. In some embodiments, in a stereorandom or racemic preparation of oligonucleotides, at least one chiral internucleotidic linkage is formed with less than 90:10, 95:5, 96:4, 97:3, or 98:2 diastereoselectivity. In some embodiments, for a stereoselective or chirally controlled preparation of oligonucleotides, each chiral internucleotidic linkage is formed with greater than 90:10, 95:5, 96:4, 97:3, or 98:2 diastereoselectivity. In some embodiments, for a stereoselective or chirally controlled preparation of oligonucleotides, each chiral internucleotidic linkage is formed with greater than 95:5 diastereoselectivity. In some embodiments, for a stereoselective or chirally controlled preparation of oligonucleotides, each chiral internucleotidic linkage is formed with greater than 96:4 diastereoselectivity. In some embodiments, for a stereoselective or chirally controlled preparation of oligonucleotides, each chiral internucleotidic linkage is formed with greater than 97:3 diastereoselectivity. In some embodiments, for a stereoselective or chirally controlled preparation of oligonucleotides, each chiral internucleotidic linkage is formed with greater than 98:2 diastereoselectivity. In some embodiments, for a stereoselective or chirally controlled preparation of oligonucleotides, each chiral internucleotidic linkage is formed with greater than 99:1 diastereoselectivity. In some embodiments, diastereoselectivity of a chiral internucleotidic linkage in an oligonucleotide may be measured through a model reaction, e.g. formation of a dimer under essentially the same or comparable conditions wherein the dimer has the same internucleotidic linkage as the chiral internucleotidic linkage, the 5'-nucleoside of the dimer is the same as the nucleoside to the 5'-end of the chiral internucleotidic linkage, and the 3'-nucleoside of the dimer is the same as the nucleoside to the 3'-end of the chiral internucleotidic linkage.

Among other things, the present disclosure provides oligonucleotide compositions and technologies for optimizing properties, e.g., activities, toxicities, etc. In some embodiments, the present disclosure provides methods for lowering toxicity of oligonucleotides and compositions thereof. In some embodiments, the present disclosure provides methods for lowering immune response associated with administration of oligonucleotides and compositions thereof (i.e., of administering oligonucleotide compositions so that undesirable immune responses to oligonucleotides in the compositions are reduced, for example relative to those observed with a reference composition of nucleotides of comparable or identical nucleotide sequence). In some embodiments, the present disclosure provides methods for lowering complement activation associated with administration of oligonucleotides and compositions thereof. In some embodiments, the present disclosure provides methods for improving protein binding profile of oligonucleotides and compositions thereof. In some embodiments, the present disclosure provides methods for increasing binding to certain proteins by oligonucleotides and compositions thereof. In some embodiments, the present disclosure provides methods for increasing binding to certain proteins by oligonucleotides and compositions thereof. In some embodiments, the present disclosure provides methods for enhancing delivery of oligonucleotides and compositions thereof. Among other things, the present disclosure encompasses the recognition that optimal delivery of oligonucleotides to their targets, in some embodiments, involves balance of oligonucleotides binding to certain proteins so that oligonucleotides can be transported to the desired locations, and oligonucleotide release so that oligonucleotides can be properly released from certain proteins to perform their desired functions, for example, hybridization with their targets, cleavage of their targets, inhibition of translation, modulation of transcript processing, etc. As exemplified in this disclosure, the present disclosure recognizes, among other things, that improvement of oligonucleotide properties can be achieved through chemical modifications and/or stereochemistry.

As described herein, provided compositions and methods are capable of altering splicing of transcripts. In some embodiments, provided compositions and methods provide improved splicing patterns of transcripts compared to reference conditions selected from the group consisting of absence of the composition, presence of a reference composition, and combinations thereof. An improvement can be an improvement of any desired biological functions. In some embodiments, for example, in DMD, an improvement is production of an mRNA from which a dystrophin protein with improved biological activities is produced. In some other embodiments, for example, an improvement is down-regulation of STAT3, HNRNPH1 and/or KDR to mitigate tumor progression, malignancy, and angiogenesis through forced splicing-induced nonsense-mediated decay (DSD-NMD).

In some embodiments, the present disclosure provides a method for altering splicing of a target transcript, comprising administering a composition comprising a first plurality of oligonucleotides, wherein the splicing of the target transcript is altered relative to reference conditions selected from the group consisting of absence of the composition, presence of a reference composition, and combinations thereof.

In some embodiments, the present disclosure provides a method of generating a set of spliced products from a target transcript, the method comprising steps of: contacting a splicing system containing the target transcript with an oligonucleotide composition comprising a first plurality of oligonucleotides, in an amount, for a time, and under conditions sufficient for a set of spliced products to be generated that is different from a set generated under reference conditions selected from the group consisting of absence of the composition, presence of a reference composition, and combinations thereof.

As widely known in the art, many diseases and/or conditions are associated with transcript splicing. For examples, see Garcia-Blanco, et al., Alternative splicing in disease and therapy, *Nat. Biotechnol.* 2004 May; 22(5):535-46; Wang, et al., Splicing in disease: disruption of the splicing code and the decoding machinery, *Nat. Rev. Genet.* 2007 October; 8(10):749-61; Havens, et al., Targeting RNA splicing for disease therapy, *Wiley Interdiscip. Rev. RNA.* 2013 May-June; 4(3):247-66. In some embodiments, the present disclosure provides compositions and methods for treating or preventing diseases.

In some embodiments, the present disclosure provides a method for treating or preventing a disease, comprising administering to a subject an oligonucleotide composition described herein.

In some embodiments, the present disclosure provides a method for treating or preventing a disease, comprising administering to a subject an oligonucleotide composition comprising a first plurality of oligonucleotides, which:

1) have a common base sequence complementary to a target sequence in a transcript; and
2) comprise one or more modified sugar moieties and modified internucleotidic linkages, the oligonucleotide composition being characterized in that, when it is contacted with the transcript in a transcript splicing system, splicing of the transcript is altered relative to that observed under reference conditions selected from the group consisting of absence of the composition, presence of a reference composition, and combinations thereof.

In some embodiments, the present disclosure provides a method for treating or preventing a disease, comprising administering to a subject an oligonucleotide composition comprising a first plurality of oligonucleotides of a particular oligonucleotide type defined by:

1) base sequence;
2) pattern of backbone linkages;
3) pattern of backbone chiral centers; and
4) pattern of backbone phosphorus modifications, which composition is chirally controlled in that it is enriched, relative to a substantially racemic preparation of oligonucleotides having the same base sequence, for oligonucleotides of the particular oligonucleotide type, wherein:

the oligonucleotide composition being characterized in that, when it is contacted with the transcript in a transcript splicing system, splicing of the transcript is altered relative to that observed under reference conditions selected from the group consisting of absence of the composition, presence of a reference composition, and combinations thereof.

In some embodiments, a disease is one in which, after administering a provided composition, one or more spliced transcripts repair, restore or introduce a new beneficial function. For example, in DMD, after skipping one or more exons, functions of dystrophin can be restored, or partially restored, through a truncated but (partially) active version. In some embodiments, a disease is one in which, after administering a provided composition, one or more spliced transcripts repair, a gene is effectively knockdown by altering splicing of the gene transcript.

In some embodiments, a disease is Duchenne muscular dystrophy. In some embodiments, a disease is spinal muscular atrophy. In some embodiments, a disease is cancer.

In some embodiments, the present disclosure provides a method of treating a disease by administering a composition comprising a first plurality of oligonucleotides sharing a common base sequence comprising a common base sequence, which nucleotide sequence is complementary to a target sequence in the target transcript, the improvement that comprises using as the oligonucleotide composition a stereocontrolled oligonucleotide composition characterized in that, when it is contacted with the transcript in a transcript splicing system, splicing of the transcript is altered relative to that observed under reference conditions selected from the group consisting of absence of the composition, presence of a reference composition, and combinations thereof.

In some embodiments, the present disclosure provides a method of treating a disease by administering a composition comprising a first plurality of oligonucleotides sharing a common base sequence comprising a common base sequence, which nucleotide sequence is complementary to a target sequence in the target transcript, the improvement that comprises using as the oligonucleotide composition a stereocontrolled oligonucleotide composition characterized in that, when it is contacted with the transcript in a transcript splicing system, splicing of the transcript is altered relative to that observed under reference conditions selected from the group consisting of absence of the composition, presence of a reference composition, and combinations thereof.

In some embodiments, a common sequence comprises a sequence selected from Table A1. In some embodiments, a common sequence is a sequence selected from Table A1.

In some embodiments, the present disclosure provides a method of administering an oligonucleotide composition comprising a first plurality of oligonucleotides having a common nucleotide sequence, the improvement that comprises:

administering an oligonucleotide composition comprising the first plurality of oligonucleotides that is chirally controlled and that is characterized by reduced toxicity relative to a reference oligonucleotide composition of the same common nucleotide sequence.

In some embodiments, the present disclosure provides a method of administering an oligonucleotide composition comprising a first plurality of oligonucleotides having a common nucleotide sequence, the improvement that comprises:

administering an oligonucleotide composition in which each oligonucleotide in the plurality comprises one or more modified sugar moieties and the composition is characterized by reduced toxicity relative to a reference oligonucleotide composition of the same common nucleotide sequence but lacking at least one of the one or more modified sugar moieties.

In some embodiments, the present disclosure provides a method of administering an oligonucleotide composition comprising a first plurality of oligonucleotides having a common nucleotide sequence, the improvement that comprises:

administering an oligonucleotide composition in which each oligonucleotide in the plurality includes one or more natural phosphate linkages and one or more modified phosphate linkages;

wherein the oligonucleotide composition is characterized by reduced toxicity when tested in at least one assay that is observed with an otherwise comparable reference composition whose oligonucleotides do not comprise natural phosphate linkages.

In some embodiments, the present disclosure provides a method of administering an oligonucleotide composition comprising a first plurality of oligonucleotides having a common nucleotide sequence, the improvement that comprises:

administering an oligonucleotide composition in which each oligonucleotide in the plurality comprises one or more modified sugar moieties and the composition is characterized by reduced toxicity relative to a reference oligonucleotide composition of the same common nucleotide sequence but lacking at least one of the one or more modified sugar moieties.

In some embodiments, the present disclosure provides a method comprising steps of administering to a subject an oligonucleotide composition comprising a first plurality of oligonucleotides each of which has a common base sequence and comprises a modified sugar moiety, wherein the oligonucleotide composition is characterized by reduced toxicity when tested in at least one assay that is observed with an otherwise comparable reference composition that comprises a reference plurality of oligonucleotides which have the same common base sequence but have no modified sugar moieties.

In some embodiments, the present disclosure provides a method comprising steps of administering to a subject an oligonucleotide composition comprising a first plurality of oligonucleotides each of which has a common base sequence and comprises one or more natural phosphate linkages and one or more modified phosphate linkages, wherein the oligonucleotide composition is characterized by reduced toxicity when tested in at least one assay that is observed with an otherwise comparable reference composition that comprises a reference plurality of oligonucleotides which have the same common base sequence but have no natural phosphate linkages.

In some embodiments, the present disclosure provides a method comprising steps of administering a chirally controlled oligonucleotide composition to a subject, wherein the chirally controlled oligonucleotide composition is characterized by reduced toxicity when tested in at least one assay that is observed with an otherwise comparable reference composition that includes a different chirally controlled oligonucleotide composition, or a stereorandom oligonucleotide composition, comprising oligonucleotides having the same base sequence.

In some embodiments, reduced toxicity is or comprises reduced complement activation. In some embodiments, reduced toxicity comprises reduced complement activation. In some embodiments, reduced toxicity is or comprises reduced complement activation. In some embodiments, reduced toxicity comprises reduced complement activation via the alternative pathway.

In some embodiments, oligonucleotides can elicit proinflammatory responses. In some embodiments, the present disclosure provides compositions and methods for reducing inflammation. In some embodiments, the present disclosure provides compositions and methods for reducing proinflammatory responses. In some embodiments, the present disclosure provides methods for reducing injection site inflammation using provided compositions. In some embodiments, the present disclosure provides methods for reducing drug-induced vascular injury using provided compositions.

In some embodiments, the present disclosure provides a method, comprising administering a composition comprising a first plurality of oligonucleotides, which composition displays reduced injection site inflammation as compared with a reference composition comprising a plurality of oligonucleotides, each of which also has the common base sequence but which differs structurally from the oligonucleotides of the first plurality in that:

individual oligonucleotides within the reference plurality differ from one another in stereochemical structure; and/or at least some oligonucleotides within the reference plurality have a structure different from a structure represented by the plurality of oligonucleotides of the composition; and/or at least some oligonucleotides within the reference plurality do not comprise a wing region and a core region.

In some embodiments, the present disclosure provides a method of administering an oligonucleotide composition comprising a first plurality of oligonucleotides having a common nucleotide sequence, the improvement that comprises:

administering an oligonucleotide comprising a first plurality of oligonucleotides that is characterized by reduced injection site inflammation relative to a reference oligonucleotide composition of the same common nucleotide sequence.

In some embodiments, the present disclosure provides a method, comprising administering a composition comprising a first plurality of oligonucleotides, which composition displays altered protein binding as compared with a reference composition comprising a plurality of oligonucleotides, each of which also has the common base sequence but which differs structurally from the oligonucleotides of the first plurality in that:

individual oligonucleotides within the reference plurality differ from one another in stereochemical structure; and/or at least some oligonucleotides within the reference plurality have a structure different from a structure represented by the plurality of oligonucleotides of the composition; and/or at least some oligonucleotides within the reference plurality do not comprise a wing region and a core region.

In some embodiments, the present disclosure provides a method of administering an oligonucleotide composition comprising a first plurality of oligonucleotides having a common nucleotide sequence, the improvement that comprises:

administering an oligonucleotide composition comprising a first plurality of oligonucleotides that is characterized by altered protein binding relative to a reference oligonucleotide composition of the same common nucleotide sequence.

In some embodiments, the present disclosure provides a method comprising administering a composition comprising a first plurality of oligonucleotides, which composition displays improved delivery as compared with a reference composition comprising a plurality of oligonucleotides, each of which also has the common base sequence but which differs structurally from the oligonucleotides of the first plurality in that:

individual oligonucleotides within the reference plurality differ from one another in stereochemical structure; and/or at least some oligonucleotides within the reference plurality have a structure different from a structure represented by the plurality of oligonucleotides of the composition; and/or at least some oligonucleotides within the reference plurality do not comprise a wing region and a core region.

In some embodiments, the present disclosure provides a method of administering an oligonucleotide composition comprising a first plurality of oligonucleotides having a common nucleotide sequence, the improvement that comprises:

administering an oligonucleotide comprising a first plurality of oligonucleotides that is characterized by improved delivery relative to a reference oligonucleotide composition of the same common nucleotide sequence.

In some embodiments, the present disclosure provides a composition comprising a chirally controlled oligonucleotide composition selected from: WV-887, WV-892, WV-896, WV-1714, WV-2444, WV-2445, WV-2526, WV-2527, WV-2528, WV-2530, WV-2531, WV-2578, WV-2580, WV-2587, WV-3047, WV-3152, WV-3472, WV-3473, WV-3507, WV-3508, WV-3509, WV-3510, WV-3511, WV-3512, WV-3513, WV-3514, WV-3515, WV-3545, and WV-3546. In some embodiments, the present disclosure provides a composition comprising a chirally controlled oligonucleotide composition selected from: WV-887, WV-892, WV-896, WV-1714, WV-2444, WV-2445, WV-2526, WV-2527, WV-2528, and WV-2530. In some embodiments, the present disclosure provides chirally controlled oligonucleotide compositions of WV-887, WV-892, WV-896, WV-1714, WV-2444, WV-2445, WV-2526, WV-2527, WV-2528, WV-2530, WV-2531, WV-2578, WV-2580, WV-2587, WV-3047, WV-3152, WV-3472, WV-3473, WV-3507, WV-3508, WV-3509, WV-3510, WV-3511, WV-3512, WV-3513, WV-3514, WV-3515, WV-3545, or WV-3546. In some embodiments, the present disclosure provides a chirally controlled oligonucleotide composition of WV-887. In some embodiments, the present disclosure provides a chirally controlled oligonucleotide composition of WV-892. In some embodiments, the present disclosure provides a chirally controlled oligonucleotide composition of WV-896. In some embodiments, the present disclosure provides a chirally controlled oligonucleotide composition of WV-1714. In some embodiments, the present disclosure provides a chirally controlled oligonucleotide composition of WV-2444. In some embodiments, the present disclosure provides a chirally controlled oligonucleotide composition of WV-2445. In some embodiments, the present disclosure provides a chirally controlled oligonucleotide composition of WV-2526. In some embodiments, the present disclosure provides a chirally controlled oligonucleotide composition of WV-2527. In some embodiments, the present disclosure provides a chirally controlled oligonucleotide composition of WV-2528. In some embodiments, the present disclosure provides a chirally controlled oligonucleotide composition of WV-2530. In some embodiments, the present disclosure provides a chirally controlled oligonucleotide composition of WV-2531. In some embodiments, the present disclosure provides a chirally controlled oligonucleotide composition of WV-2578. In some embodiments, the present disclosure provides a chirally controlled oligonucleotide composition of WV-2580. In some embodiments, the present disclosure provides a chirally controlled oligonucleotide composition of WV-2587. In some embodiments, the present disclosure provides a chirally controlled oligonucleotide composition of WV-3047. In some embodiments, the present disclosure provides a chirally controlled oligonucleotide composition of WV-3152. In some embodiments, the present disclosure provides a chirally controlled oligonucleotide composition of WV-3472. In some embodiments, the present disclosure provides a chirally controlled oligonucleotide composition of WV-3473. In some embodiments, the present disclosure provides a chirally controlled oligonucleotide composition of WV-3507. In some embodiments, the present disclosure provides a chirally controlled oligonucleotide composition of WV-3508. In some embodiments, the present disclosure provides a chirally controlled oligonucleotide composition of WV-3509. In some embodiments, the present disclosure provides a chirally controlled oligonucleotide composition of WV-3510. In some embodiments, the present disclosure provides a chirally controlled oligonucleotide composition of WV-3511. In some embodiments, the present disclosure provides a chirally controlled oligonucleotide composition of WV-3512. In some embodiments, the present disclosure provides a chirally controlled oligonucleotide composition of WV-3513. In some embodiments, the present disclosure provides a chirally controlled oligonucleotide composition of WV-3514. In some embodiments, the present disclosure provides a chirally controlled oligonucleotide composition of WV-3515. In some embodiments, the present disclosure provides a chirally controlled oligonucleotide composition of WV-3545. In some embodiments, the present disclosure provides a chirally controlled oligonucleotide composition of WV-3546. As readily appreciated by one skilled in the art, such chirally controlled oligonucleotide compositions comprise predetermined levels of WV-887, WV-892, WV-896, WV-1714, WV-2444, WV-2445, WV-2526, WV-2527, WV-2528, WV-2530, WV-2531, WV-2578, WV-2580, WV-2587, WV-3047, WV-3152, WV-3472, WV-3473, WV-3507, WV-3508, WV-3509, WV-3510, WV-3511, WV-3512, WV-3513, WV-3514, WV-3515, WV-3545, or WV-3546.

In some embodiments, the present disclosure provides a composition comprising a chirally controlled oligonucleotide composition wherein the sequence of the oligonucleotide comprises or consists of the sequence of an oligonucleotide selected from: WV-887, WV-892, WV-896, WV-1714, WV-2444, WV-2445, WV-2526, WV-2527, WV-2528, WV-2530, WV-2531, WV-2578, WV-2580, WV-2587, WV-3047, WV-3152, WV-3472, WV-3473, WV-3507, WV-3508, WV-3509, WV-3510, WV-3511, WV-3512, WV-3513, WV-3514, WV-3515, WV-3545, and WV-3546. In some embodiments, the present disclosure provides a composition comprising a chirally controlled oligonucleotide composition wherein the sequence of the oligonucleotide comprises or consists of the sequence of an oligonucleotide selected from: WV-887, WV-892, WV-896, WV-1714, WV-2444, WV-2445, WV-2526, WV-2527, WV-2528, and WV-2530.

In some embodiments, the present disclosure provides a chirally controlled oligonucleotide composition, wherein the sequence of the oligonucleotide comprises the sequence of WV-887. In some embodiments, the present disclosure provides a chirally controlled oligonucleotide composition, wherein the sequence of the oligonucleotide comprises the sequence of WV-892. In some embodiments, the present disclosure provides a chirally controlled oligonucleotide composition, wherein the sequence of the oligonucleotide comprises the sequence of WV-896. In some embodiments, the present disclosure provides a chirally controlled oligonucleotide composition, wherein the sequence of the oligonucleotide comprises the sequence of WV-1714. In some embodiments, the present disclosure provides a chirally controlled oligonucleotide composition, wherein the sequence of the oligonucleotide comprises the sequence of WV-2444. In some embodiments, the present disclosure provides a chirally controlled oligonucleotide composition, wherein the sequence of the oligonucleotide comprises the sequence of WV-2445. In some embodiments, the present disclosure provides a chirally controlled oligonucleotide composition, wherein the sequence of the oligonucleotide comprises the sequence of WV-2526. In some embodiments, the present disclosure provides a chirally controlled oligonucleotide composition, wherein the sequence of the oligonucleotide comprises the sequence of WV-2527. In some embodiments, the present disclosure provides a chirally controlled oligonucleotide composition, wherein the sequence of the oligonucleotide comprises the sequence of WV-2528. In some embodiments, the present disclosure provides a chirally controlled oligonucleotide composition, wherein the sequence of the oligonucleotide comprises the sequence of WV-2530. In some embodiments, the present disclosure provides a chirally controlled oligonucleotide composition, wherein the sequence of the oligonucleotide consists of the sequence of WV-887. In some embodiments, the present disclosure provides a chirally controlled oligonucleotide composition, wherein the sequence of the oligonucleotide consists of the sequence of WV-892. In some embodiments, the present disclosure provides a chirally controlled oligonucleotide composition, wherein the sequence of the oligonucleotide consists of the sequence of WV-896. In some embodiments, the present disclosure provides a chirally controlled oligonucleotide composition, wherein the sequence of the oligonucleotide consists of the sequence of WV-1714. In some embodiments, the present disclosure provides a chirally controlled oligonucleotide composition, wherein the sequence of the oligonucleotide consists of the sequence of WV-2444. In some embodiments, the present disclosure provides a chirally controlled oligonucleotide composition, wherein the sequence of the oligonucleotide consists of the sequence of WV-2445. In some embodiments, the present disclosure provides a chirally controlled oligonucleotide composition, wherein the sequence of the oligonucleotide consists of the sequence of WV-2526. In some embodiments, the present disclosure provides a chirally controlled oligonucleotide composition, wherein the sequence of the oligonucleotide consists of the sequence of WV-2527. In some embodiments, the present disclosure provides a chirally controlled oligonucleotide composition, wherein the sequence of the oligonucleotide consists of the sequence of WV-2528. In some embodiments, the present disclosure provides a chirally controlled oligonucleotide composition, wherein the sequence of the oligonucleotide consists of the sequence of WV-2530. In some embodiments, the present disclosure provides a chirally controlled oligonucleotide composition, wherein the sequence of the oligonucleotide consists of the sequence of WV-2531. In some embodiments, the present disclosure provides a chirally controlled oligonucleotide composition, wherein the sequence of the oligonucleotide consists of the sequence of WV-2578. In some embodiments, the present disclosure provides a chirally controlled oligonucleotide composition, wherein the sequence of the oligonucleotide consists of the sequence of WV-2580. In some embodiments, the present disclosure provides a chirally controlled oligonucleotide composition, wherein the sequence of the oligonucleotide consists of the sequence of WV-2587. In some embodiments, the present disclosure provides a chirally controlled oligonucleotide composition, wherein the sequence of the oligonucleotide consists of the sequence of WV-3047. In some embodiments, the present disclosure provides a chirally controlled oligonucleotide composition, wherein the sequence of the oligonucleotide consists of the sequence of WV-3152. In some embodiments, the present disclosure provides a chirally controlled oligonucleotide composition, wherein the sequence of the oligonucleotide consists of the sequence of WV-3472. In some embodiments, the present disclosure provides a chirally controlled oligonucleotide composition, wherein the sequence of the oligonucleotide consists of the sequence of WV-3473. In some embodiments, the present disclosure provides a chirally controlled oligonucleotide composition, wherein the sequence of the oligonucleotide consists of the sequence of WV-3507. In some embodiments, the present disclosure provides a chirally controlled oligonucleotide composition, wherein the sequence of the oligonucleotide consists of the sequence of WV-3508. In some embodiments, the present disclosure provides a chirally controlled oligonucleotide composition, wherein the sequence of the oligonucleotide consists of the sequence of WV-3509. In some embodiments, the present disclosure provides a chirally controlled oligonucleotide composition, wherein the sequence of the oligonucleotide consists of the sequence of WV-3510. In some embodiments, the present disclosure provides a chirally controlled oligonucleotide composition, wherein the sequence of the oligonucleotide consists of the sequence of WV-3511. In some embodiments, the present disclosure provides a chirally controlled oligonucleotide composition, wherein the sequence of the oligonucleotide consists of the sequence of WV-3512. In some embodiments, the present disclosure provides a chirally controlled oligonucleotide composition, wherein the sequence of the oligonucleotide consists of the sequence of WV-3513. In some embodiments, the present disclosure provides a chirally controlled oligonucleotide composition, wherein the sequence of the oligonucleotide consists of the sequence of WV-3514. In some embodiments, the present disclosure provides a chirally controlled oligonucleotide composition, wherein the sequence of the oligonucleotide consists of the sequence of WV-3515. In some embodiments, the present disclosure provides a chirally controlled oligonucleotide composition, wherein the sequence of the oligonucleotide consists of the sequence of WV-3545. In some embodiments, the present disclosure provides a chirally controlled oligonucleotide composition, wherein the sequence of the oligonucleotide consists of the sequence of WV-3546.

In some embodiments, the present disclosure provides a chirally controlled oligonucleotide composition, wherein the sequence of the oligonucleotide comprises or consists of the sequence of WV-887, wherein the composition further comprises a lipid. In some embodiments, the present disclosure provides a chirally controlled oligonucleotide composition, wherein the sequence of the oligonucleotide comprises or consists of the sequence of WV-892, wherein the composition further comprises a lipid. In some embodiments, the present disclosure provides a chirally controlled oligonucleotide composition, wherein the sequence of the oligonucleotide comprises or consists of the sequence of WV-896, wherein the composition further comprises a lipid. In some embodiments, the present disclosure provides a chirally controlled oligonucleotide composition, wherein the sequence of the oligonucleotide comprises or consists of the sequence of WV-1714, wherein the composition further comprises a lipid. In some embodiments, the present disclosure provides a chirally controlled oligonucleotide composition, wherein the sequence of the oligonucleotide comprises or consists of the sequence of WV-2444, wherein the composition further comprises a lipid. In some embodiments, the present disclosure provides a chirally controlled oligonucleotide composition, wherein the sequence of the oligonucleotide comprises or consists of the sequence of WV-2445, wherein the composition further comprises a lipid. In some embodiments, the present disclosure provides a chirally controlled oligonucleotide composition, wherein the sequence of the oligonucleotide comprises or consists of the sequence of WV-2526, wherein the composition further comprises a lipid. In some embodiments, the present disclosure provides a chirally controlled oligonucleotide composition, wherein the sequence of the oligonucleotide comprises or consists of the sequence of WV-2527, wherein the composition further comprises a lipid. In some embodiments, the present disclosure provides a chirally controlled oligonucleotide composition, wherein the sequence of the oligonucleotide comprises or consists of the sequence of WV-2528, wherein the composition further comprises a lipid. In some embodiments, the present disclosure provides a chirally controlled oligonucleotide composition, wherein the sequence of the oligonucleotide comprises or consists of the sequence of WV-2530, wherein the composition further comprises a lipid. In some embodiments, the present disclosure provides a chirally controlled oligonucleotide composition, wherein the sequence of the oligonucleotide comprises or consists of the sequence of WV-2531, wherein the composition further comprises a lipid. In some embodiments, the present disclosure provides a chirally controlled oligonucleotide composition, wherein the sequence of the oligonucleotide comprises or consists of the sequence of WV-2578, wherein the composition further comprises a lipid. In some embodiments, the present disclosure provides a chirally controlled oligonucleotide composition, wherein the sequence of the oligonucleotide comprises or consists of the sequence of WV-2580, wherein the composition further comprises a lipid. In some embodiments, the present disclosure provides a chirally controlled oligonucleotide composition, wherein the sequence of the oligonucleotide comprises or consists of the sequence of WV-2587, wherein the composition further comprises a lipid. In some embodiments, the present disclosure provides a chirally controlled oligonucleotide composition, wherein the sequence of the oligonucleotide comprises or consists of the sequence of WV-3047, wherein the composition further comprises a lipid. In some embodiments, the present disclosure provides a chirally controlled oligonucleotide composition, wherein the sequence of the oligonucleotide comprises or consists of the sequence of WV-3152, wherein the composition further comprises a lipid. In some embodiments, the present disclosure provides a chirally controlled oligonucleotide composition, wherein the sequence of the oligonucleotide comprises or consists of the sequence of WV-3472, wherein the composition further comprises a lipid. In some embodiments, the present disclosure provides a chirally controlled oligonucleotide composition, wherein the sequence of the oligonucleotide comprises or consists of the sequence of WV-3473, wherein the composition further comprises a lipid. In some embodiments, the present disclosure provides a chirally controlled oligonucleotide composition, wherein the sequence of the oligonucleotide comprises or consists of the sequence of WV-3507, wherein the composition further comprises a lipid. In some embodiments, the present disclosure provides a chirally controlled oligonucleotide composition, wherein the sequence of the oligonucleotide comprises or consists of the sequence of WV-3508, wherein the composition further comprises a lipid. In some embodiments, the present disclosure provides a chirally controlled oligonucleotide composition, wherein the sequence of the oligonucleotide comprises or consists of the sequence of WV-3509, wherein the composition further comprises a lipid. In some embodiments, the present disclosure provides a chirally controlled oligonucleotide composition, wherein the sequence of the oligonucleotide comprises or consists of the sequence of WV-3510, wherein the composition further comprises a lipid. In some embodiments, the present disclosure provides a chirally controlled oligonucleotide composition, wherein the sequence of the oligonucleotide comprises or consists of the sequence of WV-3511, wherein the composition further comprises a lipid. In some embodiments, the present disclosure provides a chirally controlled oligonucleotide composition, wherein the sequence of the oligonucleotide comprises or consists of the sequence of WV-3512, wherein the composition further comprises a lipid. In some embodiments, the present disclosure provides a chirally controlled oligonucleotide composition, wherein the sequence of the oligonucleotide comprises or consists of the sequence of WV-3513, wherein the composition further comprises a lipid. In some embodiments, the present disclosure provides a chirally controlled oligonucleotide composition, wherein the sequence of the oligonucleotide comprises or consists of the sequence of WV-3514, wherein the composition further comprises a lipid. In some embodiments, the present disclosure provides a chirally controlled oligonucleotide composition, wherein the sequence of the oligonucleotide comprises or consists of the sequence of WV-3515, wherein the composition further comprises a lipid.

In some embodiments, the present disclosure provides a chirally controlled oligonucleotide composition of WV-887 conjugated to a lipid. In some embodiments, the present disclosure provides a chirally controlled oligonucleotide composition of WV-892 conjugated to a lipid. In some embodiments, the present disclosure provides a chirally controlled oligonucleotide composition of WV-896 conjugated to a lipid. In some embodiments, the present disclosure provides a chirally controlled oligonucleotide composition of WV-1714 conjugated to a lipid. In some embodiments, the present disclosure provides a chirally controlled oligonucleotide composition of WV-2444 conjugated to a lipid. In some embodiments, the present disclosure provides a chirally controlled oligonucleotide composition of WV-2445 conjugated to a lipid. In some embodiments, the present disclosure provides a chirally controlled oligonucleotide composition of WV-2526 conjugated to a lipid. In some embodiments, the present disclosure provides a chirally controlled oligonucleotide composition of WV-2527 conjugated to a lipid. In some embodiments, the present disclosure provides a chirally controlled oligonucleotide composition of WV-2528 conjugated to a lipid. In some embodiments, the present disclosure provides a chirally controlled oligonucleotide composition of WV-2530 conjugated to a lipid. In some embodiments, the present disclosure provides a chirally controlled oligonucleotide composition of WV-2531 conjugated to a lipid. In some embodiments, the present disclosure provides a chirally controlled oligonucleotide composition of WV-2578 conjugated to a lipid. In some embodiments, the present disclosure provides a chirally controlled oligonucleotide composition of WV-2580 conjugated to a lipid. In some embodiments, the present disclosure provides a chirally controlled oligonucleotide composition of WV-2587 conjugated to a lipid. In some embodiments, the present disclosure provides a chirally controlled oligonucleotide composition of WV-3047 conjugated to a lipid. In some embodiments, the present disclosure provides a chirally controlled oligonucleotide composition of WV-3152 conjugated to a lipid. In some embodiments, the present disclosure provides a chirally controlled oligonucleotide composition of WV-3472 conjugated to a lipid. In some embodiments, the present disclosure provides a chirally controlled oligonucleotide composition of WV-3473 conjugated to a lipid. In some embodiments, the present disclosure provides a chirally controlled oligonucleotide composition of WV-3507 conjugated to a lipid. In some embodiments, the present disclosure provides a chirally controlled oligonucleotide composition of WV-3508 conjugated to a lipid. In some embodiments, the present disclosure provides a chirally controlled oligonucleotide composition of WV-3509 conjugated to a lipid. In some embodiments, the present disclosure provides a chirally controlled oligonucleotide composition of WV-3510 conjugated to a lipid. In some embodiments, the present disclosure provides a chirally controlled oligonucleotide composition of WV-3511 conjugated to a lipid. In some embodiments, the present disclosure provides a chirally controlled oligonucleotide composition of WV-3512 conjugated to a lipid. In some embodiments, the present disclosure provides a chirally controlled oligonucleotide composition of WV-3513 conjugated to a lipid. In some embodiments, the present disclosure provides a chirally controlled oligonucleotide composition of WV-3514 conjugated to a lipid. In some embodiments, the present disclosure provides a chirally controlled oligonucleotide composition of WV-3515 conjugated to a lipid. In some embodiments, the present disclosure provides a chirally controlled oligonucleotide composition of an oligonucleotide selected from any of the Tables. In some embodiments, the present disclosure provides a chirally controlled oligonucleotide composition of an oligonucleotide selected from any of the Tables, wherein the oligonucleotide is conjugated to a lipid.

In some embodiments, the oligonucleotide is no more than 25 bases long. In some embodiments, the oligonucleotide is no more than 30 bases long. n some embodiments, the oligonucleotide is no more than 35 bases long. In some embodiments, the oligonucleotide is no more than 40 bases long. In some embodiments, the oligonucleotide is no more than 45 bases long. In some embodiments, the oligonucleotide is no more than 50 bases long. In some embodiments, the oligonucleotide is no more than 55 bases long. In some embodiments, the oligonucleotide is no more than 60 bases long.

In some embodiments, a lipid is a fatty acid. In some embodiments, an oligonucleotide is conjugated to a fatty acid. In some embodiments, a fatty acid comprises 10, 11, 12, 13, 14, 15, 16, 17, 18, 19, 20, 21, 22, 23, 24, 25, 26, 27, 28, 29, 30 or more carbon atoms. In some embodiments, a fatty acid comprises 10 or more carbon atoms. In some embodiments, a fatty acid comprises 11 or more carbon atoms. In some embodiments, a fatty acid comprises 12 or more carbon atoms. In some embodiments, a fatty acid comprises 13 or more carbon atoms. In some embodiments, a fatty acid comprises 14 or more carbon atoms. In some embodiments, a fatty acid comprises 15 or more carbon atoms. In some embodiments, a fatty acid comprises 16 or more carbon atoms. In some embodiments, a fatty acid comprises 17 or more carbon atoms. In some embodiments, a fatty acid comprises 18 or more carbon atoms. In some embodiments, a fatty acid comprises 19 or more carbon atoms. In some embodiments, a fatty acid comprises 20 or more carbon atoms. In some embodiments, a fatty acid comprises 21 or more carbon atoms. In some embodiments, a fatty acid comprises 22 or more carbon atoms. In some embodiments, a fatty acid comprises 23 or more carbon atoms. In some embodiments, a fatty acid comprises 24 or more carbon atoms. In some embodiments, a fatty acid comprises 25 or more carbon atoms. In some embodiments, a fatty acid comprises 26 or more carbon atoms. In some embodiments, a fatty acid comprises 27 or more carbon atoms. In some embodiments, a fatty acid comprises 28 or more carbon atoms. In some embodiments, a fatty acid comprises 29 or more carbon atoms. In some embodiments, a fatty acid comprises 30 or more carbon atoms.

In some embodiments, a lipid is stearic acid or turbinaric acid. In some embodiments, a lipid is stearic acid. In some embodiments, a lipid is turbinaric acid.

In some embodiments, a lipid comprises an optionally substituted, $C_{10}$-$C_{80}$ saturated or partially unsaturated aliphatic group, wherein one or more methylene units are optionally and independently replaced by an optionally substituted group selected from $C_1$-$C_6$ alkylene, $C_1$-$C_6$ alkenylene, —C≡C—, a $C_1$-$C_6$ heteroaliphatic moiety, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, and —C(O)O—, wherein each variable is independently as defined and described herein.

In some embodiments, a lipid comprises an optionally substituted $C_{10}$-$C_{60}$ saturated or partially unsaturated, aliphatic chain.

In some embodiments, a lipid comprises an optionally substituted $C_{10}$-$C_{60}$ linear, saturated or partially unsaturated, aliphatic chain.

In some embodiments, a lipid comprises a $C_{10}$-$C_{60}$ linear, saturated or partially unsaturated, aliphatic chain, optionally substituted with one or more $C_{1-4}$ aliphatic group.

In some embodiments, a lipid comprises an optionally substituted, $C_{10}$-$C_{60}$ saturated or partially unsaturated aliphatic group, wherein one or more methylene units are optionally and independently replaced by an optionally substituted group selected from $C_1$-$C_6$ alkylene, $C_1$-$C_6$ alkenylene, —C≡C—, a $C_1$-$C_6$ heteroaliphatic moiety, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, and —C(O)O—, wherein each variable is independently as defined and described herein.

In some embodiments, a lipid comprises an optionally substituted $C_{10}$-$C_{60}$ saturated or partially unsaturated, aliphatic chain.

In some embodiments, a lipid comprises an optionally substituted $C_{10}$-$C_{60}$ linear, saturated or partially unsaturated, aliphatic chain.

In some embodiments, a lipid comprises a $C_{10}$-$C_{60}$ linear, saturated or partially unsaturated, aliphatic chain, optionally substituted with one or more $C_{1-4}$ aliphatic group.

In some embodiments, a lipid comprises an optionally substituted, $C_{10}$-$C_{40}$ saturated or partially unsaturated aliphatic group, wherein one or more methylene units are optionally and independently replaced by an optionally substituted group selected from $C_1$-$C_6$ alkylene, $C_1$-$C_6$ alkenylene, —C≡C—, a $C_1$-$C_6$ heteroaliphatic moiety, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, and —C(O)O—, wherein each variable is independently as defined and described herein.

In some embodiments, a lipid comprises an optionally substituted $C_{10}$-$C_{60}$ saturated or partially unsaturated, aliphatic chain.

In some embodiments, a lipid comprises an optionally substituted $C_{10}$-$C_{60}$ linear, saturated or partially unsaturated, aliphatic chain.

In some embodiments, a lipid comprises a $C_{10}$-$C_{60}$ linear, saturated or partially unsaturated, aliphatic chain, optionally substituted with one or more $C_{1-4}$ aliphatic group.

In some embodiments, a lipid comprises an unsubstituted $C_{10}$-$C_{80}$ linear, saturated or partially unsaturated, aliphatic chain.

In some embodiments, a lipid comprises no more than one optionally substituted $C_{10}$-$C_{60}$ linear, saturated or partially unsaturated, aliphatic chain.

In some embodiments, a lipid comprises two or more optionally substituted $C_{10}$-$C_{60}$ linear, saturated or partially unsaturated, aliphatic chain.

In some embodiments, a lipid comprises an unsubstituted $C_{10}$-$C_{60}$ linear, saturated or partially unsaturated, aliphatic chain.

In some embodiments, a lipid comprises no more than one optionally substituted $C_{10}$-$C_{60}$ linear, saturated or partially unsaturated, aliphatic chain.

In some embodiments, a lipid comprises two or more optionally substituted $C_{10}$-$C_{60}$ linear, saturated or partially unsaturated, aliphatic chain.

In some embodiments, a lipid comprises an unsubstituted $C_{10}$-$C_{40}$ linear, saturated or partially unsaturated, aliphatic chain.

In some embodiments, a lipid comprises no more than one optionally substituted $C_{10}$-$C_{60}$ linear, saturated or partially unsaturated, aliphatic chain.

In some embodiments, a lipid comprises two or more optionally substituted $C_{10}$-$C_{60}$ linear, saturated or partially unsaturated, aliphatic chain.

In some embodiments, a lipid comprises a $C_{10}$-$C_{40}$ linear, saturated or partially unsaturated, aliphatic chain.

In some embodiments, a lipid comprises a $C_{10}$-$C_{40}$ linear, saturated or partially unsaturated, aliphatic chain, optionally substituted with one or more $C_{1-4}$ aliphatic group.

In some embodiments, a lipid is selected from the group consisting of: lauric acid, myristic acid, palmitic acid, stearic acid, oleic acid, linoleic acid, alpha-linolenic acid, gamma-linolenic acid, docosahexaenoic acid (DHA or cis-DHA), turbinaric acid and dilinoleyl.

In some embodiments, a lipid is not conjugated to the oligonucleotide.

In some embodiments, a lipid is conjugated to the oligonucleotide.

In some embodiments, a lipid is conjugated to the oligonucleotide with a linker. In some embodiments, a linker has the structure of -L-. In some embodiments, a conjugate has the structure of $A^c$-[-$L^{LD}$-$(R^{LD})_a]_b$.

In some embodiments, the present disclosure provides an oligonucleotide composition comprising a plurality of oligonucleotides having the structure of:

$$A^c—[L^{LD}—(R^{LD})_a]_b, \quad \text{or} \quad [(A^c)_a—L^{LD}]_b—R^{LD},$$

wherein:

$A^c$ is an oligonucleotide chain ($[H]_b$-$A^c$ is an oligonucleotide);

a is 1-1000;

b is 1-1000;

each $L^{LD}$ is independently a linker moiety; and each $R^{LD}$ is independently a lipid moiety or a targeting component.

In some embodiments, the present disclosure provides an oligonucleotide composition comprising a plurality of oligonucleotides having the structure of:

$$A^c—[L^{LD}—(R^{LD})_a]_b, \quad \text{or} \quad [(A^c)_a—L^{LD}]_b—R^{LD},$$

wherein:

$A^c$ is an oligonucleotide chain ($[H]_b$-$A^c$ is an oligonucleotide);

a is 1-1000;

b is 1-1000;

each $L^{LD}$ is independently a covalent bond or an optionally substituted, $C_1$-$C_{50}$ saturated or partially unsaturated aliphatic group, wherein one or more methylene units are optionally and independently replaced by $T^{LD}$ or an optionally substituted group selected from $C_1$-$C_6$ alkylene, $C_1$-$C_6$ alkenylene, —C≡C—, a $C_1$-$C_6$ heteroaliphatic moiety, —C(R')$_2$—, —Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, and —C(O)O—;

each $R^{LD}$ is independently an optionally substituted, $C_1$-$C_{80}$ saturated or partially unsaturated aliphatic group, wherein one or more methylene units are optionally and independently replaced by an optionally substituted group selected from $C_1$-$C_6$ alkylene, $C_1$-$C_6$ alkenylene, —C≡C—, a $C_1$-$C_6$ heteroaliphatic moiety, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, and —C(O)O—;

$T^{LD}$ has the structure of:

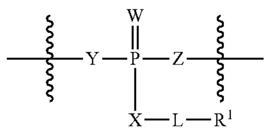
,

W is O, S or Se;

each of X, Y and Z is independently —O—, —S—, —N(-L-$R^1$)—, or L;

L is a covalent bond or an optionally substituted, linear or branched $C_1$-$C_{10}$ alkylene, wherein one or more methylene units of L are optionally and independently replaced by an optionally substituted group selected from $C_1$-$C_6$ alkylene, $C_1$-$C_6$ alkenylene, —C≡C—, a $C_1$-$C_6$ heteroaliphatic moiety, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$— —SC(O)—, —C(O)S—, —OC(O)—, and —C(O)O—;

$R^1$ is halogen, R, or an optionally substituted $C_1$-$C_{50}$ aliphatic wherein one or more methylene units are optionally and independently replaced by an optionally substituted group selected from $C_1$-$C_6$ alkylene, $C_1$-$C_6$ alkenylene, —C≡C—, a $C_1$-$C_6$ heteroaliphatic moiety, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$— —SC(O)—, —C(O)S—, —OC(O)—, and —C(O)O— each R' is independently —R, —C(O)R, —$CO_2$R, or —$SO_2$R, or:

two R' are taken together with their intervening atoms to form an optionally substituted aryl, carbocyclic, heterocyclic, or heteroaryl ring;

-Cy- is an optionally substituted bivalent ring selected from phenylene, carbocyclylene, arylene, heteroarylene, and heterocyclylene; and each R is independently hydrogen, or an optionally substituted group selected from $C_1$-$C_6$ aliphatic, carbocyclyl, aryl, heteroaryl, and heterocyclyl.

In some embodiments, $[H]_b$-$A^c$ (wherein b is 1-1000) is an oligonucleotide of any one of the Tables. In some embodiments, $[H]_b$-$A^c$ is an oligonucleotide of Table 2. In some embodiments, $[H]_b$-$A^c$ is an oligonucleotide of Table 3. In some embodiments, $[H]_b$-$A^c$ is an oligonucleotide of Table 4. In some embodiments, $[H]_b$-$A^c$ is an oligonucleotide of Table 4 comprising no lipid moieties.

In some embodiments, P in $T^{LD}$ is P*. In some embodiments, a conjugate has the structure of $[(A^c)_a$-$L^{LD}]_b$-$R^{LD}$. In some embodiments, a conjugate has the structure of $(A^c)_aL^{LD}$-$R^{LD}$. In some embodiments, a is 1-100. In some embodiments, a is 1-50. In some embodiments, a is 1-40. In some embodiments, a is 1-30. In some embodiments, a is 1-20. In some embodiments, a is 1-15. In some embodiments, a is 1-10. In some embodiments, a is 1-9. In some embodiments, a is 1-8. In some embodiments, a is 1-7. In some embodiments, a is 1-6. In some embodiments, a is 1-5. In some embodiments, a is 1-4. In some embodiments, a is 1-3. In some embodiments, a is 1-2. In some embodiments, a is 1. In some embodiments, a is 2. In some embodiments, a is 3. In some embodiments, a is 4. In some embodiments, a is 5. In some embodiments, a is 6. In some embodiments, a is 7. In some embodiments, a is 8. In some embodiments, a is 9. In some embodiments, a is 10. In some embodiments, a is more than 10. In some embodiments, b is 1-100. In some embodiments, b is 1-50. In some embodiments, b is 1-40. In some embodiments, b is 1-30. In some embodiments, b is 1-20. In some embodiments, b is 1-15. In some embodiments, b is 1-10. In some embodiments, b is 1-9. In some embodiments, b is 1-8. In some embodiments, b is 1-7. In some embodiments, b is 1-6. In some embodiments, b is 1-5. In some embodiments, b is 1-4. In some embodiments, b is 1-3. In some embodiments, b is 1-2. In some embodiments, b is 1. In some embodiments, b is 2. In some embodiments, b is 3. In some embodiments, b is 4. In some embodiments, b is 5. In some embodiments, b is 6. In some embodiments, b is 7. In some embodiments, b is 8. In some embodiments, b is 9. In some embodiments, b is 10. In some embodiments, b is more than 10. In some embodiments, a conjugate has the structure of $A^c$-$L^{LD}$-$R^{LD}$. In some embodiments, $A^c$ is conjugated through one or more of its sugar, base and/or internucleotidic linkage moieties. In some embodiments, $A^c$ is conjugated through its 5'-OH (5'-O—). In some embodiments, $A^c$ is conjugated through its 3'-OH (3'-O—). In some embodiments, before conjugation, $A^c$-$(H)_b$ (b is an integer of 1-1000 depending on valency of $A^c$) is an oligonucleotide as described herein, for example, one of those described in any one of the Tables. In some embodiments, $L^{LD}$ is -L-. In some embodiments, $L^{LD}$ comprises a phosphorothioate group. In some embodiments, $L^{LD}$ is —C(O)NH—$(CH_2)_6$—OP(=O)(S—)—O—. In some embodiments, the —C(O)NH end is connected to $R^{LD}$, and the —O— end is connected to the oligonucleotide, e.g., through 5'- or 3'-end. In some embodiments, $R^{LD}$ is optionally substituted $C_{10}$, $C_{15}$, $C_{16}$, $C_{17}$, $C_{18}$, $C_{19}$, $C_{20}$, $C_{21}$, $C_{22}$, $C_{23}$, $C_{24}$, or $C_{25}$ to $C_{20}$, $C_{21}$, $C_{22}$, $C_{23}$, $C_{24}$, $C_{25}$, $C_{26}$, $C_{27}$, $C_{28}$, $C_{29}$, $C_{30}$, $C_{35}$, $C_{40}$, $C_{45}$, $C_{50}$, $C_{60}$, $C_{70}$, or $C_{80}$ aliphatic. In some embodiments, $R^{LD}$ is optionally substituted $C_{10-80}$ aliphatic. In some embodiments, $R^{LD}$ is optionally substituted $C_{20-60}$ aliphatic. In some embodiments, $R^{LD}$ is optionally substituted $C_{10-70}$ aliphatic. In some embodiments, $R^{LD}$ is optionally substituted $C_{20-70}$ aliphatic. In some embodiments, $R^{LD}$ is optionally substituted $C_{10-60}$ aliphatic. In some embodiments, $R^{LD}$ is optionally substituted $C_{20-60}$ aliphatic. In some embodiments, $R^{LD}$ is optionally substituted $C_{10-50}$ aliphatic. In some embodiments, $R^{LD}$ is optionally substituted $C_{20-50}$ aliphatic. In some embodiments, $R^{LD}$ is optionally substituted $C_{10-40}$ aliphatic. In some embodiments, $R^{LD}$ is optionally substituted $C_{20-40}$ aliphatic. In some embodiments, $R^{LD}$ is optionally substituted $C_{10-30}$ aliphatic. In some embodiments, $R^{LD}$ is optionally substituted $C_{20-30}$ aliphatic. In some embodiments, $R^{LD}$ is unsubstituted $C_{10}$, $C_{15}$, $C_{16}$, $C_{17}$, $C_{18}$, $C_{19}$, $C_{20}$, $C_{21}$, $C_{22}$, $C_{23}$, $C_{24}$, or $C_{25}$ to $C_{20}$, $C_{21}$, $C_{22}$, $C_{23}$, $C_{24}$, $C_{25}$, $C_{26}$, $C_{27}$, $C_{28}$, $C_{29}$, $C_{30}$, $C_{35}$, $C_{40}$, $C_{45}$, $C_{50}$, $C_{60}$, $C_{70}$, or $C_{80}$ aliphatic. In some embodiments, $R^{LD}$ is unsubstituted $C_{10-80}$ aliphatic. In some embodiments, $R^{LD}$ is unsubstituted $C_{20-80}$ aliphatic. In some embodiments, $R^{LD}$ is unsubstituted $C_{10-70}$ aliphatic. In some embodiments, $R^{LD}$ is unsubstituted $C_{20-70}$ aliphatic. In some embodiments, $R^{LD}$ is unsubstituted $C_{10-60}$ aliphatic. In some embodiments, $R^{LD}$ is unsubstituted $C_{20-60}$ aliphatic. In some embodiments, $R^{LD}$ is unsubstituted $C_{10-50}$ aliphatic. In some embodiments, $R^{LD}$ is unsubstituted $C_{20-50}$ aliphatic. In some embodiments, $R^{LD}$ is unsubstituted $C_{10-40}$ aliphatic. In some embodiments, $R^{LD}$ is unsubstituted $C_{20-40}$ aliphatic. In some embodiments, $R^{LD}$ is unsubstituted $C_{10-30}$ aliphatic. In some embodiments, $R^{LD}$ is unsubstituted $C_{20-30}$ aliphatic.

In some embodiments, a chirally controlled oligonucleotide composition is any one of the preceding compositions, further comprising one or more additional components.

In some embodiments, conjugation of a lipid to an oligonucleotide improves at least one property of the oligonucleotide. In some embodiments, improved properties include increased activity (e.g., increased ability to induce desirable skipping of a deleterious exon), decreased toxicity, and/or improved distribution to a tissue. In some embodiments, a tissue is muscle tissue. In some embodiments, a tissue is skeletal muscle, gastrocnemius, triceps, heart or diaphragm. In some embodiments, improved properties include reduced hTLR9 agonist activity. In some embodiments, improved properties include hTLR9 antagonist activity. In some embodiments, improved properties include increased hTLR9 antagonist activity.

In general, properties of oligonucleotide compositions as described herein can be assessed using any appropriate assay. Relative toxicity and/or protein binding properties for different compositions (e.g., stereocontrolled vs non-stereocontrolled, and/or different stereocontrolled compositions) are typically desirably determined in the same assay, in some embodiments substantially simultaneously and in some embodiments with reference to historical results.

Those of skill in the art will be aware of and/or will readily be able to develop appropriate assays for particular oligonucleotide compositions. The present disclosure provides descriptions of certain particular assays, for example that may be useful in assessing one or more features of oligonucleotide composition behavior e.g., complement activation, injection site inflammation, protein biding, etc.

For example, certain assays that may be useful in the assessment of toxicity and/or protein binding properties of oligonucleotide compositions may include any assay described and/or exemplified herein.

Definitions

Aliphatic: The term "aliphatic" or "aliphatic group", as used herein, means a straight-chain (i.e., unbranched) or branched, substituted or unsubstituted hydrocarbon chain that is completely saturated or that contains one or more units of unsaturation, or a monocyclic hydrocarbon or bicyclic or polycyclic hydrocarbon that is completely saturated or that contains one or more units of unsaturation, but which is not aromatic (also referred to herein as "carbocycle" "cycloaliphatic" or "cycloalkyl"), that has a single point of attachment to the rest of the molecule. In some embodiments, aliphatic groups contain 1-50 aliphatic carbon atoms. Unless otherwise specified, aliphatic groups contain 1-10 aliphatic carbon atoms. In some embodiments, aliphatic groups contain 1-6 aliphatic carbon atoms. In some embodiments, aliphatic groups contain 1-5 aliphatic carbon atoms. In other embodiments, aliphatic groups contain 1-4 aliphatic carbon atoms. In still other embodiments, aliphatic groups contain 1-3 aliphatic carbon atoms, and in yet other embodiments, aliphatic groups contain 1-2 aliphatic carbon atoms. In some embodiments, "cycloaliphatic" (or "carbocycle" or "cycloalkyl") refers to a monocyclic or bicyclic $C_3$-$C_{10}$ hydrocarbon that is completely saturated or that contains one or more units of unsaturation, but which is not aromatic, that has a single point of attachment to the rest of the molecule. In some embodiments, "cycloaliphatic" (or "carbocycle" or "cycloalkyl") refers to a monocyclic $C_3$-$C_6$ hydrocarbon that is completely saturated or that contains one or more units of unsaturation, but which is not aromatic, that has a single point of attachment to the rest of the molecule. Suitable aliphatic groups include, but are not limited to, linear or branched, substituted or unsubstituted alkyl, alkenyl, alkynyl groups and hybrids thereof such as (cycloalkyl)alkyl, (cycloalkenyl)alkyl or (cycloalkyl)alkenyl.

Alkylene: The term "alkylene" refers to a bivalent alkyl group. An "alkylene chain" is a polymethylene group, i.e., $-(CH_2)_n-$, wherein n is a positive integer, preferably from 1 to 6, from 1 to 4, from 1 to 3, from 1 to 2, or from 2 to 3. A substituted alkylene chain is a polymethylene group in which one or more methylene hydrogen atoms are replaced with a substituent. Suitable substituents include those described below for a substituted aliphatic group.

Alkenylene: The term "alkenylene" refers to a bivalent alkenyl group. A substituted alkenylene chain is a polymethylene group containing at least one double bond in which one or more hydrogen atoms are replaced with a substituent. Suitable substituents include those described below for a substituted aliphatic group.

Animal: As used herein, the term "animal" refers to any member of the animal kingdom. In some embodiments, "animal" refers to humans, at any stage of development. In some embodiments, "animal" refers to non-human animals, at any stage of development. In certain embodiments, the non-human animal is a mammal (e.g., a rodent, a mouse, a rat, a rabbit, a monkey, a dog, a cat, a sheep, cattle, a primate, and/or a pig). In some embodiments, animals include, but are not limited to, mammals, birds, reptiles, amphibians, fish, and/or worms. In some embodiments, an animal may be a transgenic animal, a genetically-engineered animal, and/or a clone.

Approximately: As used herein, the terms "approximately" or "about" in reference to a number are generally taken to include numbers that fall within a range of 5%, 10%, 15%, or 20% in either direction (greater than or less than) of the number unless otherwise stated or otherwise evident from the context (except where such number would be less than 0% or exceed 100% of a possible value). In some embodiments, use of the term "about" in reference to dosages means±5 mg/kg/day.

Aryl: The term "aryl" used alone or as part of a larger moiety as in "aralkyl," "aralkoxy," or "aryloxyalkyl," refers to monocyclic and bicyclic ring systems having a total of five to fourteen ring members, wherein at least one ring in the system is aromatic and wherein each ring in the system contains three to seven ring members. The term "aryl" may be used interchangeably with the term "aryl ring." In certain embodiments of the present disclosure, "aryl" refers to an aromatic ring system which includes, but not limited to, phenyl, biphenyl, naphthyl, anthracyl and the like, which may bear one or more substituents. Also included within the scope of the term "aryl," as it is used herein, is a group in which an aromatic ring is fused to one or more non-aromatic rings, such as indanyl, phthalimidyl, naphthimidyl, phenanthridinyl, or tetrahydronaphthyl, and the like.

Characteristic portion: As used herein, the phrase a "characteristic portion" of a protein or polypeptide is one that contains a continuous stretch of amino acids, or a collection of continuous stretches of amino acids, that together are characteristic of a protein or polypeptide. Each such continuous stretch generally will contain at least two amino acids. Furthermore, those of ordinary skill in the art will appreciate that typically at least 5, 10, 15, 20 or more amino acids are required to be characteristic of a protein. In general, a characteristic portion is one that, in addition to the sequence identity specified above, shares at least one functional characteristic with the relevant intact protein.

Characteristic sequence: A "characteristic sequence" is a sequence that is found in all members of a family of polypeptides or nucleic acids, and therefore can be used by those of ordinary skill in the art to define members of the family.

Characteristic structural element: The term "characteristic structural element" refers to a distinctive structural element (e.g., core structure, collection of pendant moieties, sequence element, etc) that is found in all members of a family of polypeptides, small molecules, or nucleic acids, and therefore can be used by those of ordinary skill in the art to define members of the family.

Comparable: The term "comparable" is used herein to describe two (or more) sets of conditions or circumstances that are sufficiently similar to one another to permit comparison of results obtained or phenomena observed. In some embodiments, comparable sets of conditions or circumstances are characterized by a plurality of substantially identical features and one or a small number of varied features. Those of ordinary skill in the art will appreciate that sets of conditions are comparable to one another when characterized by a sufficient number and type of substantially identical features to warrant a reasonable conclusion that differences in results obtained or phenomena observed under the different sets of conditions or circumstances are caused by or indicative of the variation in those features that are varied.

Dosing regimen: As used herein, a "dosing regimen" or "therapeutic regimen" refers to a set of unit doses (typically more than one) that are administered individually to a subject, typically separated by periods of time. In some embodiments, a given therapeutic agent has a recommended dosing regimen, which may involve one or more doses. In some embodiments, a dosing regimen comprises a plurality of doses each of which are separated from one another by a time period of the same length; in some embodiments, a dosing regime comprises a plurality of doses and at least two different time periods separating individual doses. In some embodiments, all doses within a dosing regimen are of the same unit dose amount. In some embodiments, different doses within a dosing regimen are of different amounts. In some embodiments, a dosing regimen comprises a first dose in a first dose amount, followed by one or more additional doses in a second dose amount different from the first dose amount. In some embodiments, a dosing regimen comprises a first dose in a first dose amount, followed by one or more additional doses in a second dose amount same as the first dose amount.

Equivalent agents: Those of ordinary skill in the art, reading the present disclosure, will appreciate that the scope of useful agents in the context of the present disclosure is not limited to those specifically mentioned or exemplified herein. In particular, those skilled in the art will recognize that active agents typically have a structure that consists of a core and attached pendant moieties, and furthermore will appreciate that simple variations of such core and/or pendant moieties may not significantly alter activity of the agent. For example, in some embodiments, substitution of one or more pendant moieties with groups of comparable three-dimensional structure and/or chemical reactivity characteristics may generate a substituted compound or portion equivalent to a parent reference compound or portion. In some embodiments, addition or removal of one or more pendant moieties may generate a substituted compound equivalent to a parent reference compound. In some embodiments, alteration of core structure, for example by addition or removal of a small number of bonds (typically not more than 5, 4, 3, 2, or 1 bonds, and often only a single bond) may generate a substituted compound equivalent to a parent reference compound. In many embodiments, equivalent compounds may be prepared by methods illustrated in general reaction schemes as, for example, described below, or by modifications thereof, using readily available starting materials, reagents and conventional or provided synthesis procedures. In these reactions, it is also possible to make use of variants, which are in themselves known, but are not mentioned here.

Equivalent Dosage: The term "equivalent dosage" is used herein to compare dosages of different pharmaceutically active agents that effect the same biological result. Dosages of two different agents are considered to be "equivalent" to one another in accordance with the present disclosure if they achieve a comparable level or extent of the biological result. In some embodiments, equivalent dosages of different pharmaceutical agents for use in accordance with the present disclosure are determined using in vitro and/or in vivo assays as described herein. In some embodiments, one or more lysosomal activating agents for use in accordance with the present disclosure is utilized at a dose equivalent to a dose of a reference lysosomal activating agent; in some such embodiments, the reference lysosomal activating agent for such purpose is selected from the group consisting of small molecule allosteric activators (e.g., pyrazolpyrimidines), imminosugars (e.g., isofagomine), antioxidants (e.g., n-acetyl-cysteine), and regulators of cellular trafficking (e.g., Rab1a polypeptide).

Heteroaliphatic: The term "heteroaliphatic" refers to an aliphatic group wherein one or more units selected from C, CH, $CH_2$, or $CH_3$ are independently replaced by a heteroatom. In some embodiments, a heteroaliphatic group is heteroalkyl. In some embodiments, a heteroaliphatic group is heteroalkenyl.

Heteroaryl: The terms "heteroaryl" and "heteroar-," used alone or as part of a larger moiety, e.g., "heteroaralkyl," or "heteroaralkoxy," refer to groups having 5 to 10 ring atoms, preferably 5, 6, or 9 ring atoms; having 6, 10, or 14 $\pi$ electrons shared in a cyclic array; and having, in addition to carbon atoms, from one to five heteroatoms. The term "heteroatom" refers to nitrogen, oxygen, or sulfur, and includes any oxidized form of nitrogen or sulfur, and any quaternized form of a basic nitrogen. Heteroaryl groups include, without limitation, thienyl, furanyl, pyrrolyl, imidazolyl, pyrazolyl, triazolyl, tetrazolyl, oxazolyl, isoxazolyl, oxadiazolyl, thiazolyl, isothiazolyl, thiadiazolyl, pyridyl, pyridazinyl, pyrimidinyl, pyrazinyl, indolizinyl, purinyl, naphthyridinyl, and pteridinyl. The terms "heteroaryl" and "heteroar-," as used herein, also include groups in which a heteroaromatic ring is fused to one or more aryl, cycloaliphatic, or heterocyclyl rings, where the radical or point of attachment is on the heteroaromatic ring. Nonlimiting examples include indolyl, isoindolyl, benzothienyl, benzofuranyl, dibenzofuranyl, indazolyl, benzimidazolyl, benzthiazolyl, quinolyl, isoquinolyl, cinnolinyl, phthalazinyl, quinazolinyl, quinoxalinyl, 4H-quinolizinyl, carbazolyl, acridinyl, phenazinyl, phenothiazinyl, phenoxazinyl, tetrahydroquinolinyl, tetrahydroisoquinolinyl, and pyrido[2,3-b]-1,4-oxazin-3(4H)-one. A heteroaryl group may be mono- or bicyclic. The term "heteroaryl" may be used interchangeably with the terms "heteroaryl ring," "heteroaryl group," or "heteroaromatic," any of which terms include rings that are optionally substituted. The term "heteroaralkyl" refers to an alkyl group substituted by a heteroaryl, wherein the alkyl and heteroaryl portions independently are optionally substituted.

Heteroatom: The term "heteroatom" means one or more of oxygen, sulfur, nitrogen, phosphorus, boron, selenium, or silicon (including, any oxidized form of nitrogen, boron, selenium, sulfur, phosphorus, or silicon; the quaternized form of any basic nitrogen or; a substitutable nitrogen of a heterocyclic ring, for example N (as in 3,4-dihydro-2H-pyrrolyl), NH (as in pyrrolidinyl) or $NR^+$ (as in N-substituted pyrrolidinyl)).

Heterocycle: As used herein, the terms "heterocycle," "heterocyclyl," "heterocyclic radical," and "heterocyclic ring" are used interchangeably and refer to a stable 3- to 7-membered monocyclic or 7-10-membered bicyclic heterocyclic moiety that is either saturated or partially unsaturated, and having, in addition to carbon atoms, one or more, preferably one to four, heteroatoms, as defined above. When used in reference to a ring atom of a heterocycle, the term "nitrogen" includes a substituted nitrogen. As an example, in a saturated or partially unsaturated ring having 0-3 heteroatoms selected from oxygen, sulfur or nitrogen, the nitrogen may be N (as in 3,4-dihydro-2H-pyrrolyl), NH (as in pyrrolidinyl), or $^+NR$ (as in N-substituted pyrrolidinyl).

A heterocyclic ring can be attached to its pendant group at any heteroatom or carbon atom that results in a stable structure and any of the ring atoms can be optionally substituted. Examples of such saturated or partially unsaturated heterocyclic radicals include, without limitation, tetrahydrofuranyl, tetrahydrothiophenyl pyrrolidinyl, piperidinyl, pyrrolinyl, tetrahydroquinolinyl, tetrahydroisoquinolinyl, decahydroquinolinyl, oxazolidinyl, piperazinyl, dioxanyl, dioxolanyl, diazepinyl, oxazepinyl, thiazepinyl, morpholinyl, and quinuclidinyl. The terms "heterocycle," "heterocyclyl," "heterocyclyl ring," "heterocyclic group," "heterocyclic moiety," and "heterocyclic radical," are used interchangeably herein, and also include groups in which a heterocyclyl ring is fused to one or more aryl, heteroaryl, or cycloaliphatic rings, such as indolinyl, 3H-indolyl, chromanyl, phenanthridinyl, or tetrahydroquinolinyl, where the radical or point of attachment is on the heterocyclyl ring. A heterocyclyl group may be mono- or bicyclic. The term "heterocyclylalkyl" refers to an alkyl group substituted by a heterocyclyl, wherein the alkyl and heterocyclyl portions independently are optionally substituted.

Intraperitoneal: The phrases "intraperitoneal administration" and "administered intraperitonealy" as used herein have their art-understood meaning referring to administration of a compound or composition into the peritoneum of a subject.

In vitro: As used herein, the term "in vitro" refers to events that occur in an artificial environment, e.g., in a test tube or reaction vessel, in cell culture, etc., rather than within an organism (e.g., animal, plant, and/or microbe).

In vivo: As used herein, the term "in vivo" refers to events that occur within an organism (e.g., animal, plant, and/or microbe).

Lower alkyl: The term "lower alkyl" refers to a $C_{1-4}$ straight or branched alkyl group. Example lower alkyl groups are methyl, ethyl, propyl, isopropyl, butyl, isobutyl, and tert-butyl.

Lower haloalkyl: The term "lower haloalkyl" refers to a $C_{1-4}$ straight or branched alkyl group that is substituted with one or more halogen atoms.

Optionally substituted: As described herein, compounds of the disclosure may contain "optionally substituted" moieties. In general, the term "substituted," whether preceded by the term "optionally" or not, means that one or more hydrogens of the designated moiety are replaced with a suitable substituent. Unless otherwise indicated, an "optionally substituted" group may have a suitable substituent at each substitutable position of the group, and when more than one position in any given structure may be substituted with more than one substituent selected from a specified group, the substituent may be either the same or different at every position. Combinations of substituents envisioned by this disclosure are preferably those that result in the formation of stable or chemically feasible compounds. The term "stable," as used herein, refers to compounds that are not substantially altered when subjected to conditions to allow for their production, detection, and, in certain embodiments, their recovery, purification, and use for one or more of the purposes disclosed herein.

Suitable monovalent substituents on a substitutable carbon atom of an "optionally substituted" group are independently halogen; $—(CH_2)_{0-4}R^\circ$; $—(CH_2)_{0-4}OR^\circ$; $—O(CH_2)_{0-4}R^\circ$, $—O—(CH_2)_{0-4}C(O)OR^\circ$; $—(CH_2)_{0-4}CH(OR^\circ)_2$; $—(CH_2)_{0-4}SR^\circ$; $—(CH_2)_{0-4}Ph$, which may be substituted with $R^\circ$; $—(CH_2)_{0-4}O(CH_2)_{0-1}Ph$ which may be substituted with $R^\circ$; $—CH{=}CHPh$, which may be substituted with $R^\circ$; $—(CH_2)_{0-4}O(CH_2)_{0-1}$-pyridyl which may be substituted with $R^\circ$; $—NO_2$; $—CN$; $—N_3$; $—(CH_2)_{0-4}N(R^\circ)_2$; $—(CH_2)_{0-4}N(R^\circ)C(O)R^\circ$; $—N(R^\circ)C(S)R^\circ$; $—(CH_2)_{0-4}N(R^\circ)C(O)NR^\circ_2$; $—N(R^\circ)C(S)NR^\circ_2$; $—(CH_2)_{0-4}N(R^\circ)C(O)OR^\circ$; $—N(R^\circ)N(R^\circ)C(O)R^\circ$; $—N(R^\circ)N(R^\circ)C(O)NR^\circ_2$; $—N(R^\circ)N(R^\circ)C(O)OR^\circ$; $—(CH_2)_{0-4}C(O)R^\circ$; $—C(S)R^\circ$; $—(CH_2)_{0-4}C(O)OR^\circ$; $—(CH_2)_{0-4}C(O)SR^\circ$; $—(CH_2)_{0-4}C(O)OSiR^\circ_3$; $—(CH_2)_{0-4}OC(O)R^\circ$; $—OC(O)(CH_2)_{0-4}SR^\circ$, $—SC(S)SR^\circ$; $—(CH_2)_{0-4}SC(O)R^\circ$; $—(CH_2)_{0-4}C(O)NR^\circ_2$; $—C(S)NR^\circ_2$; $—C(S)SR^\circ$; $—SC(S)SR^\circ$, $—(CH_2)_{0-4}OC(O)NR^\circ_2$; $—C(O)N(OR^\circ)R^\circ$; $—C(O)C(O)R^\circ$; $—C(O)CH_2C(O)R^\circ$; $—C(NOR^\circ)R^\circ$; $—(CH_2)_{0-4}SSR^\circ$; $—(CH_2)_{0-4}S(O)_2R^\circ$; $—(CH_2)_{0-4}S(O)_2OR^\circ$; $—(CH_2)_{0-4}OS(O)_2R^\circ$; $—S(O)_2NR^\circ_2$; $—(CH_2)_{0-4}S(O)R^\circ$; $—N(R^\circ)S(O)_2NR^\circ_2$; $—N(R^\circ)S(O)_2R^\circ$; $—N(OR^\circ)R^\circ$; $—C(NH)NR^\circ_2$; $—P(O)_2R^\circ$; $—P(O)R^\circ_2$; $—OP(O)R^\circ_2$; $—OP(O)(OR^\circ)_2$; $—SiR^\circ_3$; $—OSiR^\circ_3$; $—(C_{1-4}$ straight or branched alkylene)$O—N(R^\circ)_2$; or $—(C_{1-4}$ straight or branched alkylene)$C(O)O—N(R^\circ)_2$, wherein each $R^\circ$ may be substituted as defined below and is independently hydrogen, $C_{1-6}$ aliphatic, $—CH_2Ph$, $—O(CH_2)_{0-1}Ph$, $—CH_2$-(5-6 membered heteroaryl ring), or a 5-6 membered saturated, partially unsaturated, or aryl ring having 0-4 heteroatoms independently selected from nitrogen, oxygen, or sulfur, or, notwithstanding the definition above, two independent occurrences of $R^\circ$, taken together with their intervening atom(s), form a 3-12 membered saturated, partially unsaturated, or aryl mono- or bicyclic ring having 0-4 heteroatoms independently selected from nitrogen, oxygen, or sulfur, which may be substituted as defined below.

Suitable monovalent substituents on $R^\circ$ (or the ring formed by taking two independent occurrences of $R^\circ$ together with their intervening atoms), are independently halogen, $—(CH_2)_{0-2}R^\bullet$, -(halo$R^\bullet$), $—(CH_2)_{0-2}OH$, $—(CH_2)_{0-2}OR^\bullet$, $—(CH_2)_{0-2}CH(OR^\bullet)_2$; $—O$(halo$R^\bullet$), $—CN$, $—N_3$, $—(CH_2)_{0-2}C(O)R^\bullet$, $—(CH_2)_{0-2}C(O)OH$, $—(CH_2)_{0-2}C(O)OR^\bullet$, $—(CH_2)_{0-2}SR^\bullet$, $—(CH_2)_{0-2}SH$, $—(CH_2)_{0-2}NH_2$, $—(CH_2)_{0-2}NHR^\bullet$, $—(CH_2)_{0-2}NR^\bullet_2$, $—NO_2$, $—SiR^\bullet_3$, $—OSiR^\circ_3$, $—C(O)SR^\bullet$, $—(C_{1-4}$ straight or branched alkylene)$C(O)OR^\bullet$, or $—SSR^\bullet$ wherein each $R^\bullet$ is unsubstituted or where preceded by "halo" is substituted only with one or more halogens, and is independently selected from $C_{1-4}$ aliphatic, $—CH_2Ph$, $—O(CH_2)_{0-1}Ph$, or a 5-6 membered saturated, partially unsaturated, or aryl ring having 0-4 heteroatoms independently selected from nitrogen, oxygen, or sulfur. Suitable divalent substituents on a saturated carbon atom of $R^\circ$ include ${=}O$ and ${=}S$.

Suitable divalent substituents on a saturated carbon atom of an "optionally substituted" group include the following: ${=}O$, ${=}S$, ${=}NNR^*_2$, ${=}NNHC(O)R^*$, ${=}NNHC(O)OR^*$, ${=}NNHS(O)_2R^*$, ${=}NR^*$, ${=}NOR^*$, $—O(C(R^*_2))_{2-3}O—$, or $—S(C(R^*_2))_{2-3}S—$, wherein each independent occurrence of $R^*$ is selected from hydrogen, $C_{1-6}$ aliphatic which may be substituted as defined below, or an unsubstituted 5-6-membered saturated, partially unsaturated, or aryl ring having 0-4 heteroatoms independently selected from nitrogen, oxygen, or sulfur. Suitable divalent substituents that are bound to vicinal substitutable carbons of an "optionally substituted" group include: $—O(CR^*_2)_{2-3}O—$, wherein each independent occurrence of $R^*$ is selected from hydrogen, $C_{1-6}$ aliphatic which may be substituted as defined below, or an unsubstituted 5-6-membered saturated, partially unsaturated, or aryl ring having 0-4 heteroatoms independently selected from nitrogen, oxygen, or sulfur.

Suitable substituents on the aliphatic group of $R^*$ include halogen, $—R^\bullet$, -(halo$R^\bullet$), $—OH$, $—OR^\bullet$, $—O$(halo$R^\bullet$), $—CN$, $—C(O)OH$, $—C(O)OR^\bullet$, $—NH_2$, $—NHR^\bullet$, $—NR^\bullet_2$, or $—NO_2$, wherein each $R^\bullet$ is unsubstituted or where preceded by "halo" is substituted only with one or more halogens, and is independently $C_{1-4}$ aliphatic, $—CH_2Ph$, $—O(CH_2)_{0-1}Ph$, or a 5-6 membered saturated, partially unsaturated, or aryl ring having 0-4 heteroatoms independently selected from nitrogen, oxygen, or sulfur.

Suitable substituents on a substitutable nitrogen of an "optionally substituted" group include $—R^\dagger$, $—NR^\dagger_2$, $—C(O)R^\dagger$, $—C(O)OR^\dagger$, $—C(O)C(O)R^\dagger$, $—C(O)CH_2C(O)R^\dagger$, $—S(O)_2R^\dagger$, $—S(O)_2NR^\dagger_2$, $—C(S)NR^\dagger_2$, $—C(NH)NR^\dagger_2$, or $—N(R^\dagger)S(O)_2R^\dagger$; wherein each $R^\dagger$ is independently hydrogen, $C_{1-6}$ aliphatic which may be substituted as defined below, unsubstituted $—OPh$, or an unsubstituted 5-6 membered saturated, partially unsaturated, or aryl ring having 0-4 heteroatoms independently selected from nitrogen, oxygen, or sulfur, or, notwithstanding the definition above, two independent occurrences of R, taken together with their intervening atom(s) form an unsubstituted 3-12 membered saturated, partially unsaturated, or aryl mono- or bicyclic ring having 0-4 heteroatoms independently selected from nitrogen, oxygen, or sulfur.

Suitable substituents on the aliphatic group of R are independently halogen, $—R^\bullet$, -(halo$R^\bullet$), $—OH$, $—OR^\bullet$, $—O$(halo$R^\bullet$), $—CN$, $—C(O)OH$, $—C(O)OR^\bullet$, $—NH_2$, $—NHR^\bullet$, $—NR^\bullet_2$, or $—NO_2$, wherein each $R^\bullet$ is unsubstituted or where preceded by "halo" is substituted only with one or more halogens, and is independently $C_{1-4}$ aliphatic, $—CH_2Ph$, $—O(CH_2)_{0-1}Ph$, or a 5-6 membered saturated, partially unsaturated, or aryl ring having 0-4 heteroatoms independently selected from nitrogen, oxygen, or sulfur.

Oral: The phrases "oral administration" and "administered orally" as used herein have their art-understood meaning referring to administration by mouth of a compound or composition.

Parenteral: The phrases "parenteral administration" and "administered parenterally" as used herein have their art-understood meaning referring to modes of administration other than enteral and topical administration, usually by injection, and include, without limitation, intravenous, intramuscular, intraarterial, intrathecal, intracapsular, intraorbital, intracardiac, intradermal, intraperitoneal, transtracheal, subcutaneous, subcuticular, intraarticulare, subcapsular, subarachnoid, intraspinal, and intrasternal injection and infusion.

Partially unsaturated: As used herein, the term "partially unsaturated" refers to a ring moiety that includes at least one double or triple bond. The term "partially unsaturated" is intended to encompass rings having multiple sites of unsaturation, but is not intended to include aryl or heteroaryl moieties, as herein defined.

Pharmaceutical composition: As used herein, the term "pharmaceutical composition" refers to an active agent, formulated together with one or more pharmaceutically acceptable carriers. In some embodiments, active agent is present in unit dose amount appropriate for administration in a therapeutic regimen that shows a statistically significant probability of achieving a predetermined therapeutic effect when administered to a relevant population. In some embodiments, pharmaceutical compositions may be specially formulated for administration in solid or liquid form, including those adapted for the following: oral administration, for example, drenches (aqueous or non-aqueous solutions or suspensions), tablets, e.g., those targeted for buccal, sublingual, and systemic absorption, boluses, powders, granules, pastes for application to the tongue; parenteral administration, for example, by subcutaneous, intramuscular, intravenous or epidural injection as, for example, a sterile solution or suspension, or sustained-release formulation; topical application, for example, as a cream, ointment, or a controlled-release patch or spray applied to the skin, lungs, or oral cavity; intravaginally or intrarectally, for example, as a pessary, cream, or foam; sublingually; ocularly; transdermally; or nasally, pulmonary, and to other mucosal surfaces.

Pharmaceutically acceptable: As used herein, the phrase "pharmaceutically acceptable" refers to those compounds, materials, compositions, and/or dosage forms which are, within the scope of sound medical judgment, suitable for use in contact with the tissues of human beings and animals without excessive toxicity, irritation, allergic response, or other problem or complication, commensurate with a reasonable benefit/risk ratio.

Pharmaceutically acceptable carrier: As used herein, the term "pharmaceutically acceptable carrier" means a pharmaceutically-acceptable material, composition or vehicle, such as a liquid or solid filler, diluent, excipient, or solvent encapsulating material, involved in carrying or transporting the subject compound from one organ, or portion of the body, to another organ, or portion of the body. Each carrier must be "acceptable" in the sense of being compatible with the other ingredients of the formulation and not injurious to the patient. Some examples of materials which can serve as pharmaceutically-acceptable carriers include: sugars, such as lactose, glucose and sucrose; starches, such as corn starch and potato starch; cellulose, and its derivatives, such as sodium carboxymethyl cellulose, ethyl cellulose and cellulose acetate; powdered tragacanth; malt; gelatin; talc; excipients, such as cocoa butter and suppository waxes; oils, such as peanut oil, cottonseed oil, safflower oil, sesame oil, olive oil, corn oil and soybean oil; glycols, such as propylene glycol; polyols, such as glycerin, sorbitol, mannitol and polyethylene glycol; esters, such as ethyl oleate and ethyl laurate; agar; buffering agents, such as magnesium hydroxide and aluminum hydroxide; alginic acid; pyrogen-free water; isotonic saline; Ringer's solution; ethyl alcohol; pH buffered solutions; polyesters, polycarbonates and/or polyanhydrides; and other non-toxic compatible substances employed in pharmaceutical formulations.

Pharmaceutically acceptable salt: The term "pharmaceutically acceptable salt", as used herein, refers to salts of such compounds that are appropriate for use in pharmaceutical contexts, i.e., salts which are, within the scope of sound medical judgment, suitable for use in contact with the tissues of humans and lower animals without undue toxicity, irritation, allergic response and the like, and are commensurate with a reasonable benefit/risk ratio. Pharmaceutically acceptable salts are well known in the art. For example, S. M. Berge, et al. describes pharmaceutically acceptable salts in detail in J. Pharmaceutical Sciences, 66: 1-19 (1977). In some embodiments, pharmaceutically acceptable salt include, but are not limited to, nontoxic acid addition salts, which are salts of an amino group formed with inorganic acids such as hydrochloric acid, hydrobromic acid, phosphoric acid, sulfuric acid and perchloric acid or with organic acids such as acetic acid, maleic acid, tartaric acid, citric acid, succinic acid or malonic acid or by using other methods used in the art such as ion exchange. In some embodiments, pharmaceutically acceptable salts include, but are not limited to, adipate, alginate, ascorbate, aspartate, benzenesulfonate, benzoate, bisulfate, borate, butyrate, camphorate, camphorsulfonate, citrate, cyclopentanepropionate, digluconate, dodecylsulfate, ethanesulfonate, formate, fumarate, glucoheptonate, glycerophosphate, gluconate, hemisulfate, heptanoate, hexanoate, hydroiodide, 2-hydroxy-ethanesulfonate, lactobionate, lactate, laurate, lauryl sulfate, malate, maleate, malonate, methanesulfonate, 2-naphthalenesulfonate, nicotinate, nitrate, oleate, oxalate, palmitate, pamoate, pectinate, persulfate, 3-phenylpropionate, phosphate, picrate, pivalate, propionate, stearate, succinate, sulfate, tartrate, thiocyanate, p-toluenesulfonate, undecanoate, valerate salts, and the like. Representative alkali or alkaline earth metal salts include sodium, lithium, potassium, calcium, magnesium, and the like. In some embodiments, pharmaceutically acceptable salts include, when appropriate, nontoxic ammonium, quaternary ammonium, and amine cations formed using counterions such as halide, hydroxide, carboxylate, sulfate, phosphate, nitrate, alkyl having from 1 to 6 carbon atoms, sulfonate and aryl sulfonate.

Prodrug: A general, a "prodrug," as that term is used herein and as is understood in the art, is an entity that, when administered to an organism, is metabolized in the body to deliver an active (e.g., therapeutic or diagnostic) agent of interest. Typically, such metabolism involves removal of at least one "prodrug moiety" so that the active agent is formed. Various forms of "prodrugs" are known in the art. For examples of such prodrug moieties, see:

a) *Design of Prodrugs*, edited by H. Bundgaard, (Elsevier, 1985) and *Methods in Enzymology,* 42:309-396, edited by K. Widder, et al. (Academic Press, 1985);
b) *Prodrugs and Targeted Delivery*, edited by J. Rautio (Wiley, 2011);
c) A Textbook of Drug Design and Development, edited by Krogsgaard-Larsen;

d) Bundgaard, Chapter 5 "Design and Application of Prodrugs", by H. Bundgaard, p. 113-191 (1991);

e) Bundgaard, *Advanced Drug Delivery Reviews,* 8:1-38 (1992);

f) Bundgaard, et al., *Journal of Pharmaceutical Sciences,* 77:285 (1988); and g) Kakeya, et al., *Chem. Pharm. Bull.,* 32:692 (1984).

As with other compounds described herein, prodrugs may be provided in any of a variety of forms, e.g., crystal forms, salt forms etc. In some embodiments, prodrugs are provided as pharmaceutically acceptable salts thereof.

Protecting group: The term "protecting group," as used herein, is well known in the art and includes those described in detail in Protecting Groups in Organic Synthesis, T. W. Greene and P. G. M. Wuts, $3^{rd}$ edition, John Wiley & Sons, 1999, the entirety of which is incorporated herein by reference. Also included are those protecting groups specially adapted for nucleoside and nucleotide chemistry described in *Current Protocols in Nucleic Acid Chemistry*, edited by Serge L. Beaucage et al. June 2012, the entirety of Chapter 2 is incorporated herein by reference. Suitable amino-protecting groups include methyl carbamate, ethyl carbamate, 9-fluorenylmethyl carbamate (Fmoc), 9-(2-sulfo)fluorenylmethyl carbamate, 9-(2,7-dibromo)fluoroenylmethyl carbamate, 2,7-di-t-butyl-[9-(10,10-dioxo-10,10,10,10-tetrahydrothioxanthyl)]methyl carbamate (DBD-Tmoc), 4-methoxyphenacyl carbamate (Phenoc), 2,2,2-trichloroethyl carbamate (Troc), 2-trimethylsilylethyl carbamate (Teoc), 2-phenylethyl carbamate (hZ), 1-(1-adamantyl)-1-methylethyl carbamate (Adpoc), 1,1-dimethyl-2-haloethyl carbamate, 1,1-dimethyl-2,2-dibromoethyl carbamate (DB-t-BOC), 1,1-dimethyl-2,2,2-trichloroethyl carbamate (TCBOC), 1-methyl-1-(4-biphenylyl)ethyl carbamate (Bpoc), 1-(3,5-di-t-butylphenyl)-1-methylethyl carbamate (t-Bumeoc), 2-(2'- and 4'-pyridyl)ethyl carbamate (Pyoc), 2-(N,N-dicyclohexylcarboxamido)ethyl carbamate, t-butyl carbamate (BOC), 1-adamantyl carbamate (Adoc), vinyl carbamate (Voc), allyl carbamate (Alloc), 1-isopropylallyl carbamate (Ipaoc), cinnamyl carbamate (Coc), 4-nitrocinnamyl carbamate (Noc), 8-quinolyl carbamate, N-hydroxypiperidinyl carbamate, alkyldithio carbamate, benzyl carbamate (Cbz), p-methoxybenzyl carbamate (Moz), p-nitobenzyl carbamate, p-bromobenzyl carbamate, p-chlorobenzyl carbamate, 2,4-dichlorobenzyl carbamate, 4-methylsulfinylbenzyl carbamate (Msz), 9-anthrylmethyl carbamate, diphenylmethyl carbamate, 2-methylthioethyl carbamate, 2-methylsulfonylethyl carbamate, 2-(p-toluenesulfonyl)ethyl carbamate, [2-(1,3-dithianyl)]methyl carbamate (Dmoc), 4-methylthiophenyl carbamate (Mtpc), 2,4-dimethylthiophenyl carbamate (Bmpc), 2-phosphonioethyl carbamate (Peoc), 2-triphenylphosphonioisopropyl carbamate (Ppoc), 1,1-dimethyl-2-cyanoethyl carbamate, m-chloro-p-acyloxybenzyl carbamate, p-(dihydroxyboryl)benzyl carbamate, 5-benzisoxazolylmethyl carbamate, 2-(trifluoromethyl)-6-chromonylmethyl carbamate (Tcroc), m-nitrophenyl carbamate, 3,5-dimethoxybenzyl carbamate, o-nitrobenzyl carbamate, 3,4-dimethoxy-6-nitrobenzyl carbamate, phenyl(o-nitrophenyl)methyl carbamate, phenothiazinyl-(10)-carbonyl derivative, N'-p-toluenesulfonylaminocarbonyl derivative, N'-phenylaminothiocarbonyl derivative, t-amyl carbamate, S-benzyl thiocarbamate, p-cyanobenzyl carbamate, cyclobutyl carbamate, cyclohexyl carbamate, cyclopentyl carbamate, cyclopropylmethyl carbamate, p-decyloxybenzyl carbamate, 2,2-dimethoxycarbonylvinyl carbamate, o-(N,N-dimethylcarboxamido)benzyl carbamate, 1,1-dimethyl-3-(N,N-dimethylcarboxamido)propyl carbamate, 1,1-dimethylpropynyl carbamate, di(2-pyridyl)methyl carbamate, 2-furanylmethyl carbamate, 2-iodoethyl carbamate, isobornyl carbamate, isobutyl carbamate, isonicotinyl carbamate, p-(p'-methoxyphenylazo)benzyl carbamate, 1-methylcyclobutyl carbamate, 1-methylcyclohexyl carbamate, 1-methyl-1-cyclopropylmethyl carbamate, 1-methyl-1-(3,5-dimethoxyphenyl)ethyl carbamate, 1-methyl-1-(p-phenylazophenyl)ethyl carbamate, 1-methyl-1-phenylethyl carbamate, 1-methyl-1-(4-pyridyl)ethyl carbamate, phenyl carbamate, p-(phenylazo)benzyl carbamate, 2,4,6-tri-t-butylphenyl carbamate, 4-(trimethylammonium)benzyl carbamate, 2,4,6-trimethylbenzyl carbamate, formamide, acetamide, chloroacetamide, trichloroacetamide, trifluoroacetamide, phenylacetamide, 3-phenylpropanamide, picolinamide, 3-pyridylcarboxamide, N-benzoylphenylalanyl derivative, benzamide, p-phenylbenzamide, o-nitophenylacetamide, o-nitrophenoxyacetamide, acetoacetamide, (N'-dithiobenzyloxycarbonylamino)acetamide, 3-(p-hydroxyphenyl)propanamide, 3-(o-nitrophenyl)propanamide, 2-methyl-2-(o-nitrophenoxy)propanamide, 2-methyl-2-(o-phenylazophenoxy)propanamide, 4-chlorobutanamide, 3-methyl-3-nitrobutanamide, o-nitrocinnamide, N-acetylmethionine derivative, o-nitrobenzamide, o-(benzoyloxymethyl)benzamide, 4,5-diphenyl-3-oxazolin-2-one, N-phthalimide, N-dithiasuccinimide (Dts), N-2,3-diphenylmaleimide, N-2,5-dimethylpyrrole, N-1,1,4,4-tetramethyldisilylazacyclopentane adduct (STABASE), 5-substituted 1,3-dimethyl-1,3,5-triazacyclohexan-2-one, 5-substituted 1,3-dibenzyl-1,3,5-triazacyclohexan-2-one, 1-substituted 3,5-dinitro-4-pyridone, N-methylamine, N-allylamine, N-[2-(trimethylsilyl)ethoxy]methylamine (SEM), N-3-acetoxypropylamine, N-(1-isopropyl-4-nitro-2-oxo-3-pyroolin-3-yl)amine, quaternary ammonium salts, N-benzylamine, N-di(4-methoxyphenyl)methylamine, N-5-dibenzosuberylamine, N-triphenylmethylamine (Tr), N-[(4-methoxyphenyl)diphenylmethyl]amine (MMTr), N-9-phenylfluorenylamine (PhF), N-2,7-dichloro-9-fluorenylmethyleneamine, N-ferrocenylmethylamino (Fcm), N-2-picolylamino N'-oxide, N-1,1-dimethylthiomethyleneamine, N-benzylideneamine, Np-methoxybenzylideneamine, N-diphenylmethyleneamine, N-[(2-pyridyl)mesityl]methyleneamine, N—(N',N'-dimethylaminomethylene)amine, N,N'-isopropylidenediamine, N-p-nitrobenzylideneamine, N-salicylideneamine, N-5-chlorosalicylideneamine, N-(5-chloro-2-hydroxyphenyl)phenylmethyleneamine, N-cyclohexylideneamine, N-(5,5-dimethyl-3-oxo-1-cyclohexenyl)amine, N-borane derivative, N-diphenylborinic acid derivative, N-[phenyl(pentacarbonylchromium- or tungsten)carbonyl]amine, N-copper chelate, N-zinc chelate, N-nitroamine, N-nitrosoamine, amine N-oxide, diphenylphosphinamide (Dpp), dimethylthiophosphinamide (Mpt), diphenylthiophosphinamide (Ppt), dialkyl phosphoramidates, dibenzyl phosphoramidate, diphenyl phosphoramidate, benzenesulfenamide, o-nitrobenzenesulfenamide (Nps), 2,4-dinitrobenzenesulfenamide, pentachlorobenzenesulfenamide, 2-nitro-4-methoxybenzenesulfenamide, triphenylmethylsulfenamide, 3-nitropyridinesulfenamide (Npys), p-toluenesulfonamide (Ts), benzenesulfonamide, 2,3,6,-trimethyl-4-methoxybenzenesulfonamide (Mtr), 2,4,6-trimethoxybenzenesulfonamide (Mtb), 2,6-dimethyl-4-methoxybenzenesulfonamide (Pme), 2,3,5,6-tetramethyl-4-methoxybenzenesulfonamide (Mte), 4-methoxybenzenesulfonamide (Mbs), 2,4,6-trimethylbenzenesulfonamide (Mts), 2,6-dimethoxy-4-methylbenzenesulfonamide (iMds), 2,2,5,7,8-pentamethylchroman-6-sulfonamide (Pmc), methanesulfonamide (Ms), β-trimethylsilylethanesulfonamide (SES), 9-anthracenesulfonamide, 4-(4',8'-dimethoxynaphthylmethyl)benzenesulfonamide (DNMBS), benzylsulfonamide, trifluoromethylsulfonamide, and phenacylsulfonamide.

Suitably protected carboxylic acids further include, but are not limited to, silyl-, alkyl-, alkenyl-, aryl-, and arylalkyl-protected carboxylic acids. Examples of suitable silyl groups include trimethylsilyl, triethylsilyl, t-butyldimethylsilyl, t-butyldiphenylsilyl, triisopropylsilyl, and the like. Examples of suitable alkyl groups include methyl, benzyl, p-methoxybenzyl, 3,4-dimethoxybenzyl, trityl, t-butyl, tetrahydropyran-2-yl. Examples of suitable alkenyl groups include allyl. Examples of suitable aryl groups include optionally substituted phenyl, biphenyl, or naphthyl. Examples of suitable arylalkyl groups include optionally substituted benzyl (e.g., p-methoxybenzyl (MPM), 3,4-dimethoxybenzyl, O-nitrobenzyl, p-nitrobenzyl, p-halobenzyl, 2,6-dichlorobenzyl, p-cyanobenzyl), and 2-and 4-picolyl.

Suitable hydroxyl protecting groups include methyl, methoxylmethyl (MOM), methylthiomethyl (MTM), t-butylthiomethyl, (phenyldimethylsilyl)methoxymethyl (SMOM), benzyloxymethyl (BOM), p-methoxybenzyloxymethyl (PMBM), (4-methoxyphenoxy)methyl (p-AOM), guaiacolmethyl (GUM), t-butoxymethyl, 4-pentenyloxymethyl (POM), siloxymethyl, 2-methoxyethoxymethyl (MEM), 2,2,2-trichloroethoxymethyl, bis(2-chloroethoxy)methyl, 2-(trimethylsilyl)ethoxymethyl (SEMOR), tetrahydropyranyl (THP), 3-bromotetrahydropyranyl, tetrahydrothiopyranyl, 1-methoxycyclohexyl, 4-methoxytetrahydropyranyl (MTHP), 4-methoxytetrahydrothiopyranyl, 4-methoxytetrahydrothiopyranyl S,S-dioxide, 1-[(2-chloro-4-methyl)phenyl]-4-methoxypiperidin-4-yl (CTMP), 1,4-dioxan-2-yl, tetrahydrofuranyl, tetrahydrothiofuranyl, 2,3,3a,4,5,6,7,7a-octahydro-7,8,8-trimethyl-4,7-methanobenzofuran-2-yl, 1-ethoxyethyl, 1-(2-chloroethoxy)ethyl, 1-methyl-1-methoxyethyl, 1-methyl-1-benzyloxyethyl, 1-methyl-1-benzyloxy-2-fluoroethyl, 2,2,2-trichloroethyl, 2-trimethylsilylethyl, 2-(phenylselenyl)ethyl, t-butyl, allyl, p-chlorophenyl, p-methoxyphenyl, 2,4-dinitrophenyl, benzyl, p-methoxybenzyl, 3,4-dimethoxybenzyl, o-nitrobenzyl, p-nitrobenzyl, p-halobenzyl, 2,6-dichlorobenzyl, p-cyanobenzyl, p-phenylbenzyl, 2-picolyl, 4-picolyl, 3-methyl-2-picolyl N-oxido, diphenylmethyl, p,p'-dinitrobenzhydryl, 5-dibenzosuberyl, triphenylmethyl, α-naphthyldiphenylmethyl, p-methoxyphenyldiphenylmethyl, di(p-methoxyphenyl)phenylmethyl, tri(p-methoxyphenyl)methyl, 4-(4'-bromophenacyloxyphenyl)diphenylmethyl, 4,4',4"-tris(4,5-dichlorophthalimidophenyl)methyl, 4,4',4"-tris(levulinoyloxyphenyl)methyl, 4,4',4"-tris(benzoyloxyphenyl)methyl, 3-(imidazol-1-yl)bis(4',4"-dimethoxyphenyl)methyl, 1,1-bis(4-methoxyphenyl)-1'-pyrenylmethyl, 9-anthryl, 9-(9-phenyl)xanthenyl, 9-(9-phenyl-10-oxo)anthryl, 1,3-benzodithiolan-2-yl, benzisothiazolyl S,S-dioxido, trimethylsilyl (TMS), triethylsilyl (TES), triisopropylsilyl (TIPS), dimethylisopropylsilyl (IPDMS), diethylisopropylsilyl (DEIPS), dimethylthexylsilyl, t-butyldimethylsilyl (TBDMS), t-butyldiphenylsilyl (TBDPS), tribenzylsilyl, tri-p-xylylsilyl, triphenylsilyl, diphenylmethylsilyl (DPMS), t-butylmethoxyphenylsilyl (TBMPS), formate, benzoylformate, acetate, chloroacetate, dichloroacetate, trichloroacetate, trifluoroacetate, methoxyacetate, triphenylmethoxyacetate, phenoxyacetate, p-chlorophenoxyacetate, 3-phenylpropionate, 4-oxopentanoate (levulinate), 4,4-(ethylenedithio)pentanoate (levulinoyldithioacetal), pivaloate, adamantoate, crotonate, 4-methoxycrotonate, benzoate, p-phenylbenzoate, 2,4,6-trimethylbenzoate (mesitoate), alkyl methyl carbonate, 9-fluorenylmethyl carbonate (Fmoc), alkyl ethyl carbonate, alkyl 2,2,2-trichloroethyl carbonate (Troc), 2-(trimethylsilyl)ethyl carbonate (TMSEC), 2-(phenylsulfonyl) ethyl carbonate (Psec), 2-(triphenylphosphonio) ethyl carbonate (Peoc), alkyl isobutyl carbonate, alkyl vinyl carbonate alkyl allyl carbonate, alkyl p-nitrophenyl carbonate, alkyl benzyl carbonate, alkyl p-methoxybenzyl carbonate, alkyl 3,4-dimethoxybenzyl carbonate, alkyl o-nitrobenzyl carbonate, alkyl p-nitrobenzyl carbonate, alkyl S-benzyl thiocarbonate, 4-ethoxy-1-napththyl carbonate, methyl dithiocarbonate, 2-iodobenzoate, 4-azidobutyrate, 4-nitro-4-methylpentanoate, o-(dibromomethyl)benzoate, 2-formylbenzenesulfonate, 2-(methylthiomethoxy)ethyl, 4-(methylthiomethoxy)butyrate, 2-(methylthiomethoxymethyl)benzoate, 2,6-dichloro-4-methylphenoxyacetate, 2,6-dichloro-4-(1,1,3,3-tetramethylbutyl)phenoxyacetate, 2,4-bis(1,1-dimethylpropyl)phenoxyacetate, chlorodiphenylacetate, isobutyrate, monosuccinoate, (E)-2-methyl-2-butenoate, o-(methoxycarbonyl)benzoate, α-naphthoate, nitrate, alkyl N,N,N',N'-tetramethylphosphorodiamidate, alkyl N-phenylcarbamate, borate, dimethylphosphinothioyl, alkyl 2,4-dinitrophenylsulfenate, sulfate, methanesulfonate (mesylate), benzylsulfonate, and tosylate (Ts). For protecting 1,2-or 1,3-diols, the protecting groups include methylene acetal, ethylidene acetal, 1-t-butylethylidene ketal, 1-phenylethylidene ketal, (4-methoxyphenyl)ethylidene acetal, 2,2,2-trichloroethylidene acetal, acetonide, cyclopentylidene ketal, cyclohexylidene ketal, cycloheptylidene ketal, benzylidene acetal, p-methoxybenzylidene acetal, 2,4-dimethoxybenzylidene ketal, 3,4-dimethoxybenzylidene acetal, 2-nitrobenzylidene acetal, methoxymethylene acetal, ethoxymethylene acetal, dimethoxymethylene ortho ester, 1-methoxyethylidene ortho ester, 1-ethoxyethylidine ortho ester, 1,2-dimethoxyethylidene ortho ester, α-methoxybenzylidene ortho ester, 1-(N,N-dimethylamino)ethylidene derivative, α-(N,N'-dimethylamino)benzylidene derivative, 2-oxacyclopentylidene ortho ester, di-t-butylsilylene group (DTBS), 1,3-(1,1,3,3-tetraisopropyldisiloxanylidene) derivative (TIPDS), tetra-t-butoxydisiloxane-1,3-diylidene derivative (TBDS), cyclic carbonates, cyclic boronates, ethyl boronate, and phenyl boronate.

In some embodiments, a hydroxyl protecting group is acetyl, t-butyl, t-butoxymethyl, methoxymethyl, tetrahydropyranyl, 1-ethoxyethyl, 1-(2-chloroethoxy)ethyl, 2-trimethylsilylethyl, p-chlorophenyl, 2,4-dinitrophenyl, benzyl, benzoyl, p-phenylbenzoyl, 2,6-dichlorobenzyl, diphenylmethyl, p-nitrobenzyl, triphenylmethyl (trityl), 4,4'-dimethoxytrityl, trimethylsilyl, triethylsilyl, t-butyldimethylsilyl, t-butyldiphenylsilyl, triphenylsilyl, triisopropylsilyl, benzoylformate, chloroacetyl, trichloroacetyl, trifiuoroacetyl, pivaloyl, 9-fluorenylmethyl carbonate, mesylate, tosylate, triflate, trityl, monomethoxytrityl (MMTr), 4,4'-dimethoxytrityl, (DMTr) and 4,4',4"-trimethoxytrityl (TMTr), 2-cyanoethyl (CE or Cne), 2-(trimethylsilyl)ethyl (TSE), 2-(2-nitrophenyl)ethyl, 2-(4-cyanophenyl)ethyl 2-(4-nitrophenyl)ethyl (NPE), 2-(4-nitrophenylsulfonyl)ethyl, 3,5-dichlorophenyl, 2,4-dimethylphenyl, 2-nitrophenyl, 4-nitrophenyl, 2,4,6-trimethylphenyl, 2-(2-nitrophenyl)ethyl, butylthiocarbonyl, 4,4',4"-tris(benzoyloxy)trityl, diphenylcarbamoyl, levulinyl, 2-(dibromomethyl)benzoyl (Dbmb), 2-(isopropylthiomethoxymethyl)benzoyl (Ptmt), 9-phenylxanthen-9-yl (pixyl) or 9-(p-methoxyphenyl)xanthine-9-y1 (MOX). In some embodiments, each of the hydroxyl protecting groups is, independently selected from acetyl, benzyl, t-butyldimethylsilyl, t-butyldiphenylsilyl and 4,4'-dimethoxytrityl. In some embodiments, the hydroxyl protecting group is selected from the group consisting of trityl, monomethoxytrityl and 4,4'-dimethoxytrityl group.

In some embodiments, a phosphorous protecting group is a group attached to the internucleotide phosphorous linkage throughout oligonucleotide synthesis. In some embodiments, the phosphorous protecting group is attached to the sulfur atom of the internucleotide phosphorothioate linkage. In some embodiments, the phosphorous protecting group is attached to the oxygen atom of the internucleotide phosphorothioate linkage. In some embodiments, the phosphorous protecting group is attached to the oxygen atom of the internucleotide phosphate linkage. In some embodiments the phosphorous protecting group is 2-cyanoethyl (CE or Cne), 2-trimethylsilylethyl, 2-nitroethyl, 2-sulfonylethyl, methyl, benzyl, o-nitrobenzyl, 2-(p-nitrophenyl)ethyl (NPE or Npe), 2-phenylethyl, 3-(N-tert-butylcarboxamido)-1-propyl, 4-oxopentyl, 4-methylthio-1-butyl, 2-cyano-1,1-dimethylethyl, 4-N-methylaminobutyl, 3-(2-pyridyl)-1-propyl, 2-[N-methyl-N-(2-pyridyl)]aminoethyl, 2-(N-formyl,N-methyl)aminoethyl, 4-[N-methyl-N-(2,2,2-trifluoroacetyl)amino]butyl.

Protein: As used herein, the term "protein" refers to a polypeptide (i.e., a string of at least two amino acids linked to one another by peptide bonds). In some embodiments, proteins include only naturally-occurring amino acids. In some embodiments, proteins include one or more non-naturally-occurring amino acids (e.g., moieties that form one or more peptide bonds with adjacent amino acids). In some embodiments, one or more residues in a protein chain contain a non-amino-acid moiety (e.g., a glycan, etc). In some embodiments, a protein includes more than one polypeptide chain, for example linked by one or more disulfide bonds or associated by other means. In some embodiments, proteins contain L-amino acids, D-amino acids, or both; in some embodiments, proteins contain one or more amino acid modifications or analogs known in the art. Useful modifications include, e.g., terminal acetylation, amidation, methylation, etc. The term "peptide" is generally used to refer to a polypeptide having a length of less than about 100 amino acids, less than about 50 amino acids, less than 20 amino acids, or less than 10 amino acids. In some embodiments, proteins are antibodies, antibody fragments, biologically active portions thereof, and/or characteristic portions thereof.

Sample: A "sample" as used herein is a specific organism or material obtained therefrom. In some embodiments, a sample is a biological sample obtained or derived from a source of interest, as described herein. In some embodiments, a source of interest comprises an organism, such as an animal or human. In some embodiments, a biological sample comprises biological tissue or fluid. In some embodiments, a biological sample is or comprises bone marrow; blood; blood cells; ascites; tissue or fine needle biopsy samples; cell-containing body fluids; free floating nucleic acids; sputum; saliva; urine; cerebrospinal fluid, peritoneal fluid; pleural fluid; feces; lymph; gynecological fluids; skin swabs; vaginal swabs; oral swabs; nasal swabs; washings or lavages such as a ductal lavages or broncheoalveolar lavages; aspirates; scrapings; bone marrow specimens; tissue biopsy specimens; surgical specimens; feces, other body fluids, secretions, and/or excretions; and/or cells therefrom, etc. In some embodiments, a biological sample is or comprises cells obtained from an individual. In some embodiments, a sample is a "primary sample" obtained directly from a source of interest by any appropriate means. For example, in some embodiments, a primary biological sample is obtained by methods selected from the group consisting of biopsy (e.g., fine needle aspiration or tissue biopsy), surgery, collection of body fluid (e.g., blood, lymph, feces etc.), etc. In some embodiments, as will be clear from context, the term "sample" refers to a preparation that is obtained by processing (e.g., by removing one or more components of and/or by adding one or more agents to) a primary sample. For example, filtering using a semi-permeable membrane. Such a "processed sample" may comprise, for example nucleic acids or proteins extracted from a sample or obtained by subjecting a primary sample to techniques such as amplification or reverse transcription of mRNA, isolation and/or purification of certain components, etc. In some embodiments, a sample is an organism. In some embodiments, a sample is a plant. In some embodiments, a sample is an animal. In some embodiments, a sample is a human. In some embodiments, a sample is an organism other than a human.

Stereochemically isomeric forms: The phrase "stereochemically isomeric forms," as used herein, refers to different compounds made up of the same atoms bonded by the same sequence of bonds but having different three-dimensional structures which are not interchangeable. In some embodiments of the disclosure, provided chemical compositions may be or include pure preparations of individual stereochemically isomeric forms of a compound; in some embodiments, provided chemical compositions may be or include mixtures of two or more stereochemically isomeric forms of the compound. In certain embodiments, such mixtures contain equal amounts of different stereochemically isomeric forms; in certain embodiments, such mixtures contain different amounts of at least two different stereochemically isomeric forms. In some embodiments, a chemical composition may contain all diastereomers and/or enantiomers of the compound. In some embodiments, a chemical composition may contain less than all diastereomers and/or enantiomers of a compound. In some embodiments, if a particular enantiomer of a compound of the present disclosure is desired, it may be prepared, for example, by asymmetric synthesis, or by derivation with a chiral auxiliary, where the resulting diastereomeric mixture is separated and the auxiliary group cleaved to provide the pure desired enantiomers. Alternatively, where the molecule contains a basic functional group, such as amino, diastereomeric salts are formed with an appropriate optically-active acid, and resolved, for example, by fractional crystallization.

Subject: As used herein, the term "subject" or "test subject" refers to any organism to which a provided compound or composition is administered in accordance with the present disclosure e.g., for experimental, diagnostic, prophylactic, and/or therapeutic purposes. Typical subjects include animals (e.g., mammals such as mice, rats, rabbits, non-human primates, and humans; insects; worms; etc.) and plants. In some embodiments, a subject may be suffering from, and/or susceptible to a disease, disorder, and/or condition.

Substantially: As used herein, the term "substantially" refers to the qualitative condition of exhibiting total or near-total extent or degree of a characteristic or property of interest. One of ordinary skill in the biological arts will understand that biological and chemical phenomena rarely, if ever, go to completion and/or proceed to completeness or achieve or avoid an absolute result. The term "substantially" is therefore used herein to capture the potential lack of completeness inherent in many biological and/or chemical phenomena.

Suffering from: An individual who is "suffering from" a disease, disorder, and/or condition has been diagnosed with and/or displays one or more symptoms of a disease, disorder, and/or condition.

Susceptible to: An individual who is "susceptible to" a disease, disorder, and/or condition is one who has a higher risk of developing the disease, disorder, and/or condition than does a member of the general public. In some embodiments, an individual who is susceptible to a disease, disorder and/or condition may not have been diagnosed with the disease, disorder, and/or condition. In some embodiments, an individual who is susceptible to a disease, disorder, and/or condition may exhibit symptoms of the disease, disorder, and/or condition. In some embodiments, an individual who is susceptible to a disease, disorder, and/or condition may not exhibit symptoms of the disease, disorder, and/or condition. In some embodiments, an individual who is susceptible to a disease, disorder, and/or condition will develop the disease, disorder, and/or condition. In some embodiments, an individual who is susceptible to a disease, disorder, and/or condition will not develop the disease, disorder, and/or condition.

Systemic: The phrases "systemic administration," "administered systemically," "peripheral administration," and "administered peripherally" as used herein have their art-understood meaning referring to administration of a compound or composition such that it enters the recipient's system.

Tautomeric forms: The phrase "tautomeric forms," as used herein, is used to describe different isomeric forms of organic compounds that are capable of facile interconversion. Tautomers may be characterized by the formal migration of a hydrogen atom or proton, accompanied by a switch of a single bond and adjacent double bond. In some embodiments, tautomers may result from prototropic tautomerism (i.e., the relocation of a proton). In some embodiments, tautomers may result from valence tautomerism (i.e., the rapid reorganization of bonding electrons). All such tautomeric forms are intended to be included within the scope of the present disclosure. In some embodiments, tautomeric forms of a compound exist in mobile equilibrium with each other, so that attempts to prepare the separate substances results in the formation of a mixture. In some embodiments, tautomeric forms of a compound are separable and isolatable compounds. In some embodiments of the disclosure, chemical compositions may be provided that are or include pure preparations of a single tautomeric form of a compound. In some embodiments of the disclosure, chemical compositions may be provided as mixtures of two or more tautomeric forms of a compound. In certain embodiments, such mixtures contain equal amounts of different tautomeric forms; in certain embodiments, such mixtures contain different amounts of at least two different tautomeric forms of a compound. In some embodiments of the disclosure, chemical compositions may contain all tautomeric forms of a compound. In some embodiments of the disclosure, chemical compositions may contain less than all tautomeric forms of a compound. In some embodiments of the disclosure, chemical compositions may contain one or more tautomeric forms of a compound in amounts that vary over time as a result of interconversion. In some embodiments of the disclosure, the tautomerism is keto-enol tautomerism. One of skill in the chemical arts would recognize that a keto-enol tautomer can be "trapped" (i.e., chemically modified such that it remains in the "enol" form) using any suitable reagent known in the chemical arts in to provide an enol derivative that may subsequently be isolated using one or more suitable techniques known in the art. Unless otherwise indicated, the present disclosure encompasses all tautomeric forms of relevant compounds, whether in pure form or in admixture with one another.

Therapeutic agent: As used herein, the phrase "therapeutic agent" refers to any agent that, when administered to a subject, has a therapeutic effect and/or elicits a desired biological and/or pharmacological effect. In some embodiments, a therapeutic agent is any substance that can be used to alleviate, ameliorate, relieve, inhibit, prevent, delay onset of, reduce severity of, and/or reduce incidence of one or more symptoms or features of a disease, disorder, and/or condition.

Therapeutically effective amount: As used herein, the term "therapeutically effective amount" means an amount of a substance (e.g., a therapeutic agent, composition, and/or formulation) that elicits a desired biological response when administered as part of a therapeutic regimen. In some embodiments, a therapeutically effective amount of a substance is an amount that is sufficient, when administered to a subject suffering from or susceptible to a disease, disorder, and/or condition, to treat, diagnose, prevent, and/or delay the onset of the disease, disorder, and/or condition. As will be appreciated by those of ordinary skill in this art, the effective amount of a substance may vary depending on such factors as the desired biological endpoint, the substance to be delivered, the target cell or tissue, etc. For example, the effective amount of compound in a formulation to treat a disease, disorder, and/or condition is the amount that alleviates, ameliorates, relieves, inhibits, prevents, delays onset of, reduces severity of and/or reduces incidence of one or more symptoms or features of the disease, disorder, and/or condition. In some embodiments, a therapeutically effective amount is administered in a single dose; in some embodiments, multiple unit doses are required to deliver a therapeutically effective amount.

Treat: As used herein, the term "treat," "treatment," or "treating" refers to any method used to partially or completely alleviate, ameliorate, relieve, inhibit, prevent, delay onset of, reduce severity of, and/or reduce incidence of one or more symptoms or features of a disease, disorder, and/or condition. Treatment may be administered to a subject who does not exhibit signs of a disease, disorder, and/or condition. In some embodiments, treatment may be administered to a subject who exhibits only early signs of the disease, disorder, and/or condition, for example for the purpose of decreasing the risk of developing pathology associated with the disease, disorder, and/or condition.

Unsaturated: The term "unsaturated," as used herein, means that a moiety has one or more units of unsaturation.

Unit dose: The expression "unit dose" as used herein refers to an amount administered as a single dose and/or in a physically discrete unit of a pharmaceutical composition. In many embodiments, a unit dose contains a predetermined quantity of an active agent. In some embodiments, a unit dose contains an entire single dose of the agent. In some embodiments, more than one unit dose is administered to achieve a total single dose. In some embodiments, administration of multiple unit doses is required, or expected to be required, in order to achieve an intended effect. A unit dose may be, for example, a volume of liquid (e.g., an acceptable carrier) containing a predetermined quantity of one or more therapeutic agents, a predetermined amount of one or more therapeutic agents in solid form, a sustained release formulation or drug delivery device containing a predetermined amount of one or more therapeutic agents, etc. It will be appreciated that a unit dose may be present in a formulation that includes any of a variety of components in addition to the therapeutic agent(s). For example, acceptable carriers (e.g., pharmaceutically acceptable carriers), diluents, stabilizers, buffers, preservatives, etc., may be included as described infra. It will be appreciated by those skilled in the art, in many embodiments, a total appropriate daily dosage of a particular therapeutic agent may comprise a portion, or a plurality, of unit doses, and may be decided, for example, by the attending physician within the scope of sound medical judgment. In some embodiments, the specific effective dose level for any particular subject or organism may depend upon a variety of factors including the disorder being treated and the severity of the disorder; activity of specific active compound employed; specific composition employed; age, body weight, general health, sex and diet of the subject; time of administration, and rate of excretion of the specific active compound employed; duration of the treatment; drugs and/or additional therapies used in combination or coincidental with specific compound(s) employed, and like factors well known in the medical arts.

Wild-type: As used herein, the term "wild-type" has its art-understood meaning that refers to an entity having a structure and/or activity as found in nature in a "normal" (as contrasted with mutant, diseased, altered, etc) state or context. Those of ordinary skill in the art will appreciate that wild type genes and polypeptides often exist in multiple different forms (e.g., alleles).

Nucleic acid: The term "nucleic acid" includes any nucleotides, analogs thereof, and polymers thereof. The term "polynucleotide" as used herein refer to a polymeric form of nucleotides of any length, either ribonucleotides (RNA) or deoxyribonucleotides (DNA). These terms refer to the primary structure of the molecules and, thus, include double- and single-stranded DNA, and double- and single-stranded RNA. These terms include, as equivalents, analogs of either RNA or DNA made from nucleotide analogs and modified polynucleotides such as, though not limited to, methylated, protected and/or capped nucleotides or polynucleotides. The terms encompass poly- or oligo-ribonucleotides (RNA) and poly- or oligo-deoxyribonucleotides (DNA); RNA or DNA derived from N-glycosides or C-glycosides of nucleobases and/or modified nucleobases; nucleic acids derived from sugars and/or modified sugars; and nucleic acids derived from phosphate bridges and/or modified phosphorus-atom bridges (also referred to herein as "internucleotide linkages"). The term encompasses nucleic acids containing any combinations of nucleobases, modified nucleobases, sugars, modified sugars, phosphate bridges or modified phosphorus atom bridges. Examples include, and are not limited to, nucleic acids containing ribose moieties, the nucleic acids containing deoxy-ribose moieties, nucleic acids containing both ribose and deoxyribose moieties, nucleic acids containing ribose and modified ribose moieties. The prefix poly- refers to a nucleic acid containing 2 to about 10,000 nucleotide monomer units and wherein the prefix oligo- refers to a nucleic acid containing 2 to about 200 nucleotide monomer units.

Nucleotide: The term "nucleotide" as used herein refers to a monomeric unit of a polynucleotide that consists of a heterocyclic base, a sugar, and one or more phosphate groups or phosphorus-containing internucleotidic linkages. The naturally occurring bases, (guanine, (G), adenine, (A), cytosine, (C), thymine, (T), and uracil (U)) are derivatives of purine or pyrimidine, though it should be understood that naturally and non-naturally occurring base analogs are also included. The naturally occurring sugar is the pentose (five-carbon sugar) deoxyribose (which forms DNA) or ribose (which forms RNA), though it should be understood that naturally and non-naturally occurring sugar analogs are also included. Nucleotides are linked via internucleotidic linkages to form nucleic acids, or polynucleotides. Many internucleotidic linkages are known in the art (such as, though not limited to, phosphate, phosphorothioates, boranophosphates and the like). Artificial nucleic acids include PNAs (peptide nucleic acids), phosphotriesters, phosphorothionates, H-phosphonates, phosphoramidates, boranophosphates, methylphosphonates, phosphonoacetates, thiophosphonoacetates and other variants of the phosphate backbone of native nucleic acids, such as those described herein.

Nucleoside: The term "nucleoside" refers to a moiety wherein a nucleobase or a modified nucleobase is covalently bound to a sugar or modified sugar.

Sugar: The term "sugar" refers to a monosaccharide in closed and/or open form. Sugars include, but are not limited to, ribose, deoxyribose, pentofuranose, pentopyranose, and hexopyranose moieties. As used herein, the term also encompasses structural analogs used in lieu of conventional sugar molecules, such as glycol, polymer of which forms the backbone of the nucleic acid analog, glycol nucleic acid ("GNA").

Modified sugar: The term "modified sugar" refers to a moiety that can replace a sugar. The modified sugar mimics the spatial arrangement, electronic properties, or some other physicochemical property of a sugar.

Nucleobase: The term "nucleobase" refers to the parts of nucleic acids that are involved in the hydrogen-bonding that binds one nucleic acid strand to another complementary strand in a sequence specific manner. The most common naturally-occurring nucleobases are adenine (A), guanine (G), uracil (U), cytosine (C), and thymine (T). In some embodiments, the naturally-occurring nucleobases are modified adenine, guanine, uracil, cytosine, or thymine. In some embodiments, the naturally-occurring nucleobases are methylated adenine, guanine, uracil, cytosine, or thymine. In some embodiments, a nucleobase is a "modified nucleobase," e.g., a nucleobase other than adenine (A), guanine (G), uracil (U), cytosine (C), and thymine (T). In some embodiments, the modified nucleobases are methylated adenine, guanine, uracil, cytosine, or thymine. In some embodiments, the modified nucleobase mimics the spatial arrangement, electronic properties, or some other physicochemical property of the nucleobase and retains the property of hydrogen-bonding that binds one nucleic acid strand to another in a sequence specific manner. In some embodiments, a modified nucleobase can pair with all of the five naturally occurring bases (uracil, thymine, adenine, cytosine, or guanine) without substantially affecting the melting behavior, recognition by intracellular enzymes or activity of the oligonucleotide duplex.

Chiral ligand: The term "chiral ligand" or "chiral auxiliary" refers to a moiety that is chiral and can be incorporated into a reaction so that the reaction can be carried out with certain stereoselectivity.

Condensing reagent: In a condensation reaction, the term "condensing reagent" refers to a reagent that activates a less reactive site and renders it more susceptible to attack by another reagent. In some embodiments, such another reagent is a nucleophile.

Blocking group: The term "blocking group" refers to a group that masks the reactivity of a functional group. The functional group can be subsequently unmasked by removal of the blocking group. In some embodiments, a blocking group is a protecting group.

Moiety: The term "moiety" refers to a specific segment or functional group of a molecule. Chemical moieties are often recognized chemical entities embedded in or appended to a molecule.

Solid support: The term "solid support" refers to any support which enables synthesis of nucleic acids. In some embodiments, the term refers to a glass or a polymer, that is insoluble in the media employed in the reaction steps performed to synthesize nucleic acids, and is derivatized to comprise reactive groups. In some embodiments, the solid support is Highly Cross-linked Polystyrene (HCP) or Controlled Pore Glass (CPG). In some embodiments, the solid support is Controlled Pore Glass (CPG). In some embodiments, the solid support is hybrid support of Controlled Pore Glass (CPG) and Highly Cross-linked Polystyrene (HCP).

Linking moiety: The term "linking moiety" refers to any moiety optionally positioned between the terminal nucleoside and the solid support or between the terminal nucleoside and another nucleoside, nucleotide, or nucleic acid.

DNA molecule: A "DNA molecule" refers to the polymeric form of deoxyribonucleotides (adenine, guanine, thymine, or cytosine) in its either single stranded form or a double-stranded helix. This term refers only to the primary and secondary structure of the molecule, and does not limit it to any particular tertiary forms. Thus, this term includes double-stranded DNA found, inter alia, in linear DNA molecules (e.g., restriction fragments), viruses, plasmids, and chromosomes. In discussing the structure of particular double-stranded DNA molecules, sequences can be described herein according to the normal convention of giving only the sequence in the 5' to 3' direction along the non-transcribed strand of DNA (i.e., the strand having a sequence homologous to the mRNA).

Coding sequence: A DNA "coding sequence" or "coding region" is a double-stranded DNA sequence which is transcribed and translated into a polypeptide in vivo when placed under the control of appropriate expression control sequences. The boundaries of the coding sequence (the "open reading frame" or "ORF") are determined by a start codon at the 5' (amino) terminus and a translation stop codon at the 3' (carboxyl) terminus. A coding sequence can include, but is not limited to, prokaryotic sequences, cDNA from eukaryotic mRNA, genomic DNA sequences from eukaryotic (e.g., mammalian) DNA, and synthetic DNA sequences. A polyadenylation signal and transcription termination sequence is, usually, be located 3' to the coding sequence. The term "non-coding sequence" or "non-coding region" refers to regions of a polynucleotide sequence that are not translated into amino acids (e.g. 5' and 3' un-translated regions).

Reading frame: The term "reading frame" refers to one of the six possible reading frames, three in each direction, of the double stranded DNA molecule. The reading frame that is used determines which codons are used to encode amino acids within the coding sequence of a DNA molecule.

Antisense: As used herein, an "antisense" nucleic acid molecule comprises a nucleotide sequence which is complementary to a "sense" nucleic acid encoding a protein, e.g., complementary to the coding strand of a double-stranded cDNA molecule, complementary to an mRNA sequence or complementary to the coding strand of a gene. Accordingly, an antisense nucleic acid molecule can associate via hydrogen bonds to a sense nucleic acid molecule.

Wobble position: As used herein, a "wobble position" refers to the third position of a codon. Mutations in a DNA molecule within the wobble position of a codon, in some embodiments, result in silent or conservative mutations at the amino acid level. For example, there are four codons that encode Glycine, i.e., GGU, GGC, GGA and GGG, thus mutation of any wobble position nucleotide, to any other nucleotide selected from A, U, C and G, does not result in a change at the amino acid level of the encoded protein and, therefore, is a silent substitution.

Silent substitution: a "silent substitution" or "silent mutation" is one in which a nucleotide within a codon is modified, but does not result in a change in the amino acid residue encoded by the codon. Examples include mutations in the third position of a codon, as well in the first position of certain codons such as in the codon "CGG" which, when mutated to AGG, still encodes Arg.

Gene: The terms "gene," "recombinant gene" and "gene construct" as used herein, refer to a DNA molecule, or portion of a DNA molecule, that encodes a protein or a portion thereof. The DNA molecule can contain an open reading frame encoding the protein (as exon sequences) and can further include intron sequences. The term "intron" as used herein, refers to a DNA sequence present in a given gene which is not translated into protein and is found in some, but not all cases, between exons. It can be desirable for the gene to be operably linked to, (or it can comprise), one or more promoters, enhancers, repressors and/or other regulatory sequences to modulate the activity or expression of the gene, as is well known in the art.

Complementary DNA: As used herein, a "complementary DNA" or "cDNA" includes recombinant polynucleotides synthesized by reverse transcription of mRNA and from which intervening sequences (introns) have been removed.

Homology: "Homology" or "identity" or "similarity" refers to sequence similarity between two nucleic acid molecules. Homology and identity can each be determined by comparing a position in each sequence which can be aligned for purposes of comparison. When an equivalent position in the compared sequences is occupied by the same base, then the molecules are identical at that position; when the equivalent site occupied by the same or a similar nucleic acid residue (e.g., similar in steric and/or electronic nature), then the molecules can be referred to as homologous (similar) at that position. Expression as a percentage of homology/similarity or identity refers to a function of the number of identical or similar nucleic acids at positions shared by the compared sequences. A sequence which is "unrelated" or "non-homologous" shares less than 40% identity, less than 35% identity, less than 30% identity, or less than 25% identity with a sequence described herein. In comparing two sequences, the absence of residues (amino acids or nucleic acids) or presence of extra residues also decreases the identity and homology/similarity.

In some embodiments, the term "homology" describes a mathematically based comparison of sequence similarities which is used to identify genes with similar functions or motifs. The nucleic acid sequences described herein can be used as a "query sequence" to perform a search against public databases, for example, to identify other family members, related sequences or homologs. In some embodiments, such searches can be performed using the NBLAST and XBLAST programs (version 2.0) of Altschul, et al. (1990) J. Mol. Biol. 215:403-10. In some embodiments, BLAST nucleotide searches can be performed with the NBLAST program, score=100, wordlength=12 to obtain nucleotide sequences homologous to nucleic acid molecules of the disclosure. In some embodiments, to obtain gapped alignments for comparison purposes, Gapped BLAST can be utilized as described in Altschul et al., (1997) Nucleic Acids Res. 25(17):3389-3402. When utilizing BLAST and Gapped BLAST programs, the default parameters of the respective programs (e.g., XBLAST and BLAST) can be used (See www.ncbi.nlm.nih.gov).

Identity: As used herein, "identity" means the percentage of identical nucleotide residues at corresponding positions in two or more sequences when the sequences are aligned to maximize sequence matching, i.e., taking into account gaps and insertions. Identity can be readily calculated by known methods, including but not limited to those described in (Computational Molecular Biology, Lesk, A. M., ed., Oxford University Press, New York, 1988; Biocomputing: Informatics and Genome Projects, Smith, D. W., ed., Academic Press, New York, 1993; Computer Analysis of Sequence Data, Part I, Griffin, A. M., and Griffin, H. G., eds., Humana Press, New Jersey, 1994; Sequence Analysis in Molecular Biology, von Heinje, G., Academic Press, 1987; and Sequence Analysis Primer, Gribskov, M. and Devereux, J., eds., M Stockton Press, New York, 1991; and Carillo, H., and Lipman, D., SIAM J. Applied Math., 48: 1073 (1988). Methods to determine identity are designed to give the largest match between the sequences tested. Moreover, methods to determine identity are codified in publicly available computer programs. Computer program methods to determine identity between two sequences include, but are not limited to, the GCG program package (Devereux, J., et al., Nucleic Acids Research 12(1): 387 (1984)), BLASTP, BLASTN, and FASTA (Altschul, S. F. et al., J. Molec. Biol. 215: 403-410 (1990) and Altschul et al. Nuc. Acids Res. 25: 3389-3402 (1997)). The BLAST X program is publicly available from NCBI and other sources (BLAST Manual, Altschul, S., et al., NCBI NLM NIH Bethesda, Md. 20894; Altschul, S., et al., J. Mol. Biol. 215: 403-410 (1990). The well-known Smith Waterman algorithm can also be used to determine identity.

Heterologous: A "heterologous" region of a DNA sequence is an identifiable segment of DNA within a larger DNA sequence that is not found in association with the larger sequence in nature. Thus, when the heterologous region encodes a mammalian gene, the gene can usually be flanked by DNA that does not flank the mammalian genomic DNA in the genome of the source organism. Another example of a heterologous coding sequence is a sequence where the coding sequence itself is not found in nature (e.g., a cDNA where the genomic coding sequence contains introns or synthetic sequences having codons or motifs different than the unmodified gene). Allelic variations or naturally-occurring mutational events do not give rise to a heterologous region of DNA as defined herein.

Transition mutation: The term "transition mutations" refers to base changes in a DNA sequence in which a pyrimidine (cytidine (C) or thymidine (T) is replaced by another pyrimidine, or a purine (adenosine (A) or guanosine (G) is replaced by another purine.

Transversion mutation: The term "transversion mutations" refers to base changes in a DNA sequence in which a pyrimidine (cytidine (C) or thymidine (T) is replaced by a purine (adenosine (A) or guanosine (G), or a purine is replaced by a pyrimidine.

Oligonucleotide: the term "oligonucleotide" refers to a polymer or oligomer of nucleotide monomers, containing any combination of nucleobases, modified nucleobases, sugars, modified sugars, phosphate bridges, or modified phosphorus atom bridges (also referred to herein as "internucleotidic linkage", defined further herein).

Oligonucleotides can be single-stranded or double-stranded. As used herein, the term "oligonucleotide strand" encompasses a single-stranded oligonucleotide. A single-stranded oligonucleotide can have double-stranded regions and a double-stranded oligonucleotide can have single-stranded regions. Example oligonucleotides include, but are not limited to structural genes, genes including control and termination regions, self-replicating systems such as viral or plasmid DNA, single-stranded and double-stranded siRNAs and other RNA interference reagents (RNAi agents or iRNA agents), shRNA, antisense oligonucleotides, ribozymes, microRNAs, microRNA mimics, supermirs, aptamers, antimirs, antagomirs, UI adaptors, triplex-forming oligonucleotides, G-quadruplex oligonucleotides, RNA activators, immuno-stimulatory oligonucleotides, and decoy oligonucleotides.

Double-stranded and single-stranded oligonucleotides that are effective in inducing RNA interference are also referred to as siRNA, RNAi agent, or iRNA agent, herein. In some embodiments, these RNA interference inducing oligonucleotides associate with a cytoplasmic multi-protein complex known as RNAi-induced silencing complex (RISC). In many embodiments, single-stranded and double-stranded RNAi agents are sufficiently long that they can be cleaved by an endogenous molecule, e.g., by Dicer, to produce smaller oligonucleotides that can enter the RISC machinery and participate in RISC mediated cleavage of a target sequence, e.g. a target mRNA.

Oligonucleotides of the present disclosure can be of various lengths. In particular embodiments, oligonucleotides can range from about 2 to about 200 nucleotides in length. In various related embodiments, oligonucleotides, single-stranded, double-stranded, and triple-stranded, can range in length from about 4 to about 10 nucleotides, from about 10 to about 50 nucleotides, from about 20 to about 50 nucleotides, from about 15 to about 30 nucleotides, from about 20 to about 30 nucleotides in length. In some embodiments, the oligonucleotide is from about 9 to about 39 nucleotides in length. In some embodiments, the oligonucleotide is at least 4 nucleotides in length. In some embodiments, the oligonucleotide is at least 5 nucleotides in length. In some embodiments, the oligonucleotide is at least 6 nucleotides in length. In some embodiments, the oligonucleotide is at least 7 nucleotides in length. In some embodiments, the oligonucleotide is at least 8 nucleotides in length. In some embodiments, the oligonucleotide is at least 9 nucleotides in length. In some embodiments, the oligonucleotide is at least 10 nucleotides in length. In some embodiments, the oligonucleotide is at least 11 nucleotides in length. In some embodiments, the oligonucleotide is at least 12 nucleotides in length. In some embodiments, the oligonucleotide is at least 15 nucleotides in length. In some embodiments, the oligonucleotide is at least 20 nucleotides in length. In some embodiments, the oligonucleotide is at least 25 nucleotides in length. In some embodiments, the oligonucleotide is at least 30 nucleotides in length. In some embodiments, the oligonucleotide is a duplex of complementary strands of at least 18 nucleotides in length. In some embodiments, the oligonucleotide is a duplex of complementary strands of at least 21 nucleotides in length.

Internucleotidic linkage: As used herein, the phrase "internucleotidic linkage" refers generally to the phosphorus-containing linkage between nucleotide units of an oligonucleotide, and is interchangeable with "inter-sugar linkage" and "phosphorus atom bridge," as used above and herein. In some embodiments, an internucleotidic linkage is a phosphodiester linkage, as found in naturally occurring DNA and RNA molecules. In some embodiments, an internucleotidic linkage is a "modified internucleotidic linkage" wherein each oxygen atom of the phosphodiester linkage is optionally and independently replaced by an organic or inorganic moiety. In some embodiments, such an organic or inorganic moiety is selected from but not limited to =S, =Se, =NR', —SR', —SeR', —N(R')$_2$, B(R')$_3$, —S—, —Se—, and —N(R')—, wherein each R' is independently as defined and described below. In some embodiments, an internucleotidic linkage is a phosphotriester linkage, phosphorothioate diester linkage ( 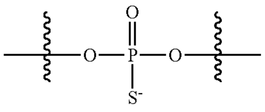 ), or modified phosphorothioate triester linkage. It is understood by a person of ordinary skill in the art that the internucleotidic linkage may exist as an anion or cation at a given pH due to the existence of acid or base moieties in the linkage.

Unless otherwise specified, when used with an oligonucleotide sequence, each of s, s1, s2, s3, s4, s5, s6 and s7 independently represents the following modified internucleotidic linkage as illustrated below:

| Symbol | Modified Internucleotidic Linkage |
| --- | --- |
| s | phosphorothioate ( 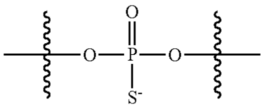 ) |
| s1 | 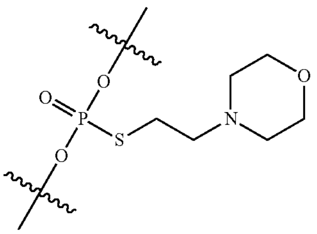 |
| s2 | 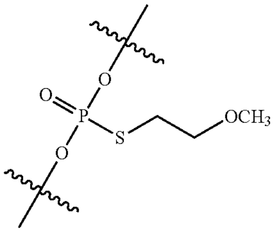 |
| s3 | 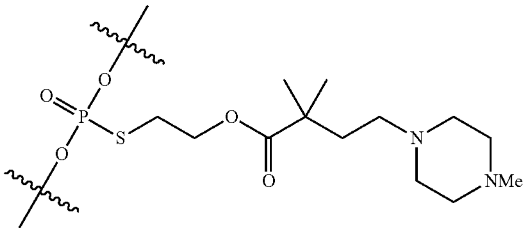 |
| s4 | 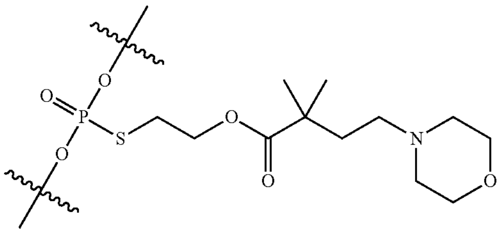 |

-continued
| Symbol | Modified Internucleotidic Linkage |
| --- | --- |
| s5 | 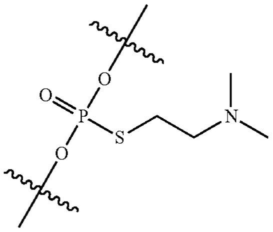 |
| s6 | 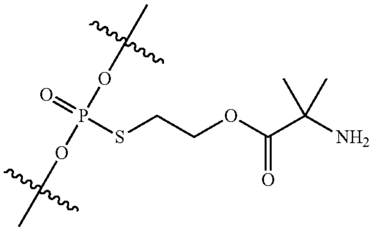 |
| s7 | 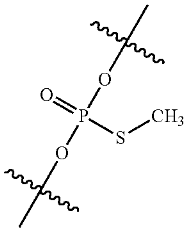 |
| s8 | 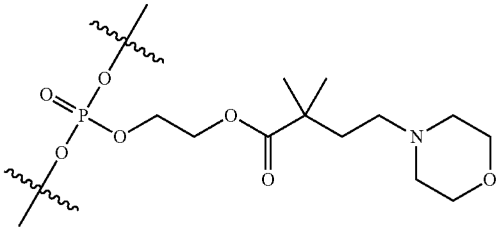 |
| s9 | 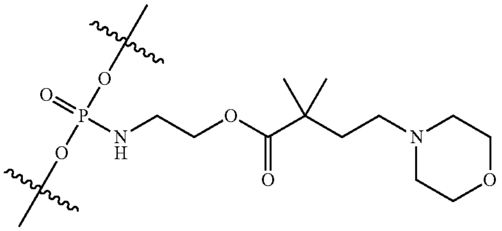 |
| s10 | 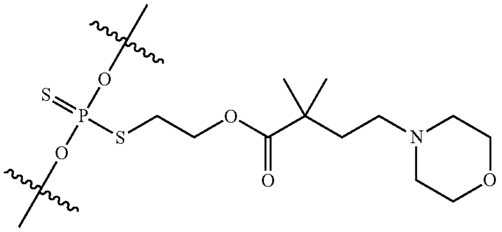 |

-continued
| Symbol | Modified Internucleotidic Linkage |
| --- | --- |
| s11 | 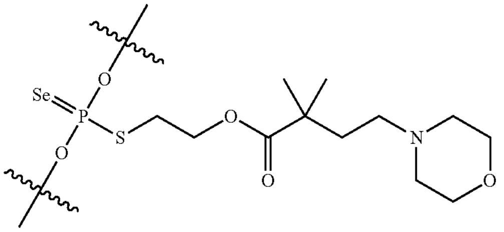 |
| s12 | 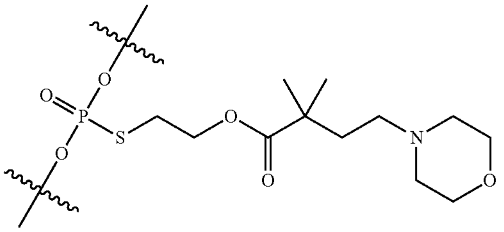 |
| s13 | 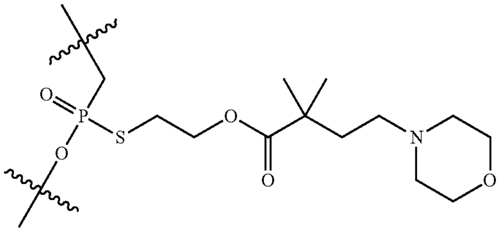 |
| s14 | 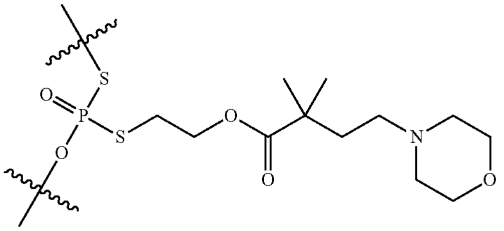 |
| s15 | 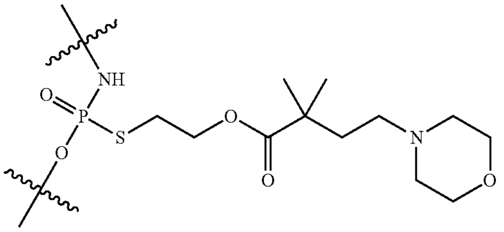 |
| s16 | 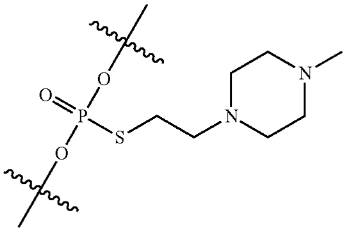 |

-continued

| Symbol | Modified Internucleotidic Linkage |
| --- | --- |
| s17 | 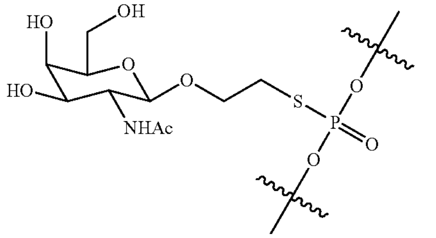 |
| s18 | 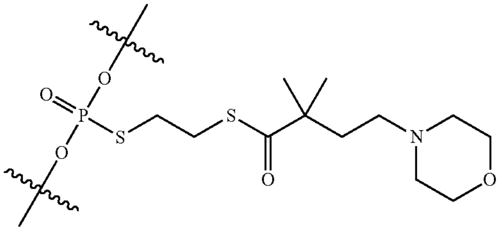 |

For instance, (Rp, Sp)-ATsCs1GA has 1) a phosphorothioate internucleotidic linkage

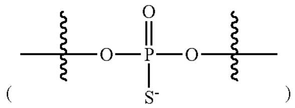

between T and C; and 2) a phosphorothioate triester internucleotidic linkage having the structure of

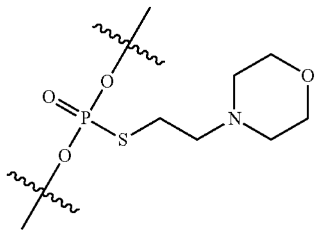

between C and G. Unless otherwise specified, the Rp/Sp designations preceding an oligonucleotide sequence describe the configurations of chiral linkage phosphorus atoms in the internucleotidic linkages sequentially from 5' to 3' of the oligonucleotide sequence. For instance, in (Rp, Sp)-ATsCs1GA, the phosphorus in the "s" linkage between T and C has Rp configuration and the phosphorus in "s1" linkage between C and G has Sp configuration. In some embodiments, "All-(Rp)" or "All-(Sp)" is used to indicate that all chiral linkage phosphorus atoms in oligonucleotide have the same Rp or Sp configuration, respectively. For instance, All-(Rp)-GsCsCsTsCsAsGsTsCsTsGsCsTsTsCsGsCsAsCsC (SEQ ID NO: 1) indicates that all the chiral linkage phosphorus atoms in the oligonucleotide have Rp configuration; All-(Sp)-GsCsCsTsCsAsGsTsCsTsGsCsTsTsCsGsCsAsCsC (SEQ ID NO: 2) indicates that all the chiral linkage phosphorus atoms in the oligonucleotide have Sp configuration.

Oligonucleotide type: As used herein, the phrase "oligonucleotide type" is used to define an oligonucleotide that has a particular base sequence, pattern of backbone linkages (i.e., pattern of internucleotidic linkage types, for example, phosphate, phosphorothioate, etc), pattern of backbone chiral centers (i.e. pattern of linkage phosphorus stereochemistry (Rp/Sp)), and pattern of backbone phosphorus modifications (e.g., pattern of "—XLR$^1$" groups in formula I). Oligonucleotides of a common designated "type" are structurally identical to one another.

One of skill in the art will appreciate that synthetic methods of the present disclosure provide for a degree of control during the synthesis of an oligonucleotide strand such that each nucleotide unit of the oligonucleotide strand can be designed and/or selected in advance to have a particular stereochemistry at the linkage phosphorus and/or a particular modification at the linkage phosphorus, and/or a particular base, and/or a particular sugar. In some embodiments, an oligonucleotide strand is designed and/or selected in advance to have a particular combination of stereocenters at the linkage phosphorus. In some embodiments, an oligonucleotide strand is designed and/or determined to have a particular combination of modifications at the linkage phosphorus. In some embodiments, an oligonucleotide strand is designed and/or selected to have a particular combination of bases. In some embodiments, an oligonucleotide strand is designed and/or selected to have a particular combination of one or more of the above structural characteristics. The present disclosure provides compositions comprising or consisting of a plurality of oligonucleotide molecules (e.g., chirally controlled oligonucleotide compositions). In some embodiments, all such molecules are of the same type (i.e., are structurally identical to one another). In many embodiments, however, provided compositions comprise a plurality of oligonucleotides of different types, typically in predetermined relative amounts.

Chiral control: As used herein, "chiral control" refers to an ability to control the stereochemical designation of every chiral linkage phosphorus within an oligonucleotide strand. The phrase "chirally controlled oligonucleotide" refers to an oligonucleotide which exists in a single diastereomeric form with respect to the chiral linkage phosphorus.

Chirally controlled oligonucleotide composition: As used herein, the phrase "chirally controlled oligonucleotide composition" refers to an oligonucleotide composition that contains predetermined levels of individual oligonucleotide types. For instance, in some embodiments a chirally controlled oligonucleotide composition comprises one oligonucleotide type. In some embodiments, a chirally controlled oligonucleotide composition comprises more than one oligonucleotide type. In some embodiments, a chirally controlled oligonucleotide composition comprises a mixture of multiple oligonucleotide types. Example chirally controlled oligonucleotide compositions are described further herein.

Chirally pure: as used herein, the phrase "chirally pure" is used to describe a chirally controlled oligonucleotide composition in which all of the oligonucleotides exist in a single diastereomeric form with respect to the linkage phosphorus.

Chirally uniform: as used herein, the phrase "chirally uniform" is used to describe an oligonucleotide molecule or type in which all nucleotide units have the same stereochemistry at the linkage phosphorus. For instance, an oligonucleotide whose nucleotide units all have Rp stereochemistry at the linkage phosphorus is chirally uniform. Likewise, an oligonucleotide whose nucleotide units all have Sp stereochemistry at the linkage phosphorus is chirally uniform.

Predetermined: By predetermined is meant deliberately selected, for example as opposed to randomly occurring or achieved. Those of ordinary skill in the art, reading the present specification, will appreciate that the present disclosure provides new and surprising technologies that permit selection of particular oligonucleotide types for preparation and/or inclusion in provided compositions, and further permits controlled preparation of precisely the selected particular types, optionally in selected particular relative amounts, so that provided compositions are prepared. Such provided compositions are "predetermined" as described herein. Compositions that may contain certain individual oligonucleotide types because they happen to have been generated through a process that cannot be controlled to intentionally generate the particular oligonucleotide types is not a "predetermined" composition. In some embodiments, a predetermined composition is one that can be intentionally reproduced (e.g., through repetition of a controlled process).

Linkage phosphorus: as defined herein, the phrase "linkage phosphorus" is used to indicate that the particular phosphorus atom being referred to is the phosphorus atom present in the internucleotidic linkage, which phosphorus atom corresponds to the phosphorus atom of a phosphodiester of an internucleotidic linkage as occurs in naturally occurring DNA and RNA. In some embodiments, a linkage phosphorus atom is in a modified internucleotidic linkage, wherein each oxygen atom of a phosphodiester linkage is optionally and independently replaced by an organic or inorganic moiety. In some embodiments, a linkage phosphorus atom is P* of formula I. In some embodiments, a linkage phosphorus atom is chiral. In some embodiments, a chiral linkage phosphorus atom is P* of formula I.

P-modification: as used herein, the term "P-modification" refers to any modification at the linkage phosphorus other than a stereochemical modification. In some embodiments, a P-modification comprises addition, substitution, or removal of a pendant moiety covalently attached to a linkage phosphorus. In some embodiments, the "P-modification" is —X-L-$R^1$ wherein each of X, L and $R^1$ is independently as defined and described herein and below.

Blockmer: the term "blockmer," as used herein, refers to an oligonucleotide strand whose pattern of structural features characterizing each individual nucleotide unit is characterized by the presence of at least two consecutive nucleotide units sharing a common structural feature at the internucleotidic phosphorus linkage. By common structural feature is meant common stereochemistry at the linkage phosphorus or a common modification at the linkage phosphorus. In some embodiments, the at least two consecutive nucleotide units sharing a common structure feature at the internucleotidic phosphorus linkage are referred to as a "block".

In some embodiments, a blockmer is a "stereoblockmer," e.g., at least two consecutive nucleotide units have the same stereochemistry at the linkage phosphorus. Such at least two consecutive nucleotide units form a "stereoblock." For instance, (Sp, Sp)-ATsCs1GA is a stereoblockmer because at least two consecutive nucleotide units, the Ts and the Cs1, have the same stereochemistry at the linkage phosphorus (both Sp). In the same oligonucleotide (Sp, Sp)-ATsCs1GA, TsCs1 forms a block, and it is a stereoblock.

In some embodiments, a blockmer is a "P-modification blockmer," e.g., at least two consecutive nucleotide units have the same modification at the linkage phosphorus. Such at least two consecutive nucleotide units form a "P-modification block". For instance, (Rp, Sp)-ATsCsGA is a P-modification blockmer because at least two consecutive nucleotide units, the Ts and the Cs, have the same P-modification (i.e., both are a phosphorothioate diester). In the same oligonucleotide of (Rp, Sp)-ATsCsGA, TsCs forms a block, and it is a P-modification block.

In some embodiments, a blockmer is a "linkage blockmer," e.g., at least two consecutive nucleotide units have identical stereochemistry and identical modifications at the linkage phosphorus. At least two consecutive nucleotide units form a "linkage block". For instance, (Rp, Rp)-ATsCsGA is a linkage blockmer because at least two consecutive nucleotide units, the Ts and the Cs, have the same stereochemistry (both Rp) and P-modification (both phosphorothioate). In the same oligonucleotide of (Rp, Rp)-ATsCsGA, TsCs forms a block, and it is a linkage block.

In some embodiments, a blockmer comprises one or more blocks independently selected from a stereoblock, a P-modification block and a linkage block. In some embodiments, a blockmer is a stereoblockmer with respect to one block, and/or a P-modification blockmer with respect to another block, and/or a linkage blockmer with respect to yet another block. For instance, (Rp, Rp, Rp, Rp, Rp, Sp, Sp, Sp)-AAsTsCsGsAs1Ts1Cs1Gs1ATCG (SEQ ID NO: 3) is a stereoblockmer with respect to the stereoblock AsTsCsGsAs1 (all Rp at linkage phosphorus) or Ts1Cs1Gs1 (all Sp at linkage phosphorus), a P-modification blockmer with respect to the P-modification block AsTsCsGs (all s linkage) or As1Ts1Cs1Gs1 (all s1 linkage), or a linkage blockmer with respect to the linkage block AsTsCsGs (all Rp at linkage phosphorus and all s linkage) or Ts1Cs1Gs1 (all Sp at linkage phosphorus and all s1 linkage).

Altmer: the term "altmer," as used herein, refers to an oligonucleotide strand whose pattern of structural features characterizing each individual nucleotide unit is characterized in that no two consecutive nucleotide units of the oligonucleotide strand share a particular structural feature at the internucleotidic phosphorus linkage. In some embodiments, an altmer is designed such that it comprises a repeating pattern. In some embodiments, an altmer is designed such that it does not comprise a repeating pattern.

In some embodiments, an altmer is a "stereoaltmer," e.g., no two consecutive nucleotide units have the same stereochemistry at the linkage phosphorus. For instance, (Rp, Sp, Rp, Sp, Rp, Sp, Rp, Sp, Rp, Sp Rp, Sp, Rp, Sp, Rp, Sp, Rp, Sp, Rp)-GsCsCsTsCsAsGsTsCsTsGsCsTsTsCsGsCsAsCsC (SEQ ID NO: 4).

In some embodiments, an altmer is a "P-modification altmer" e.g., no two consecutive nucleotide units have the same modification at the linkage phosphorus. For instance, All-(Sp)-CAs1GsT, in which each linkage phosphorus has a different P-modification than the others.

In some embodiments, an altmer is a "linkage altmer," e.g., no two consecutive nucleotide units have identical stereochemistry or identical modifications at the linkage phosphorus. For instance, (Rp, Sp, Rp, Sp, Rp, Sp, Rp, Sp, Rp, Sp Rp, Sp, Rp, Sp, Rp, Sp, Rp, Sp, Rp)-GsCs1CsTs1CsAs1GsTs1CsTs1GsCs1TsTs2CsGs3CsAs4 CsC (SEQ ID NO: 5).

Unimer: the term "unimer," as used herein, refers to an oligonucleotide strand whose pattern of structural features characterizing each individual nucleotide unit is such that all nucleotide units within the strand share at least one common structural feature at the internucleotidic phosphorus linkage. By common structural feature is meant common stereochemistry at the linkage phosphorus or a common modification at the linkage phosphorus.

In some embodiments, a unimer is a "stereounimer," e.g., all nucleotide units have the same stereochemistry at the linkage phosphorus. For instance, All-(Sp)-CsAs1GsT, in which all the linkages have Sp phosphorus.

In some embodiments, a unimer is a "P-modification unimer", e.g., all nucleotide units have the same modification at the linkage phosphorus. For instance, (Rp, Sp, Rp, Sp, Rp, Sp, Rp, Sp, Rp, Sp Rp, Sp, Rp, Sp, Rp, Sp, Rp, Sp, Rp)-GsCsCsTsCsAsGsTsCsTsGsCsTsTsCsGsCsAsCsC (SEQ ID NO: 4), in which all the internucleotidic linkages are phosphorothioate diester.

In some embodiments, a unimer is a "linkage unimer," e.g., all nucleotide units have the same stereochemistry and the same modifications at the linkage phosphorus. For instance, All-(Sp)-GsCsCsTsCsAsGsTsCsTsGsCsTsTsCsGsCsAsCsC (SEQ ID NO: 2), in which all the internucleotidic linkages are phosphorothioate diester having Sp linkage phosphorus.

Gapmer: as used herein, the term "gapmer" refers to an oligonucleotide strand characterized in that at least one internucleotidic phosphorus linkage of the oligonucleotide strand is a phosphate diester linkage, for example such as those found in naturally occurring DNA or RNA. In some embodiments, more than one internucleotidic phosphorus linkage of the oligonucleotide strand is a phosphate diester linkage such as those found in naturally occurring DNA or RNA. For instance, All-(Sp)-CAs1GsT, in which the internucleotidic linkage between C and A is a phosphate diester linkage.

Skipmer: as used herein, the term "skipmer" refers to a type of gapmer in which every other internucleotidic phosphorus linkage of the oligonucleotide strand is a phosphate diester linkage, for example such as those found in naturally occurring DNA or RNA, and every other internucleotidic phosphorus linkage of the oligonucleotide strand is a modified internucleotidic linkage. For instance, All-(Sp)-AsTCs1GAs2TCs3G.

For purposes of this disclosure, the chemical elements are identified in accordance with the Periodic Table of the Elements, CAS version, Handbook of Chemistry and Physics, 67th Ed., 1986-87, inside cover.

The methods and structures described herein relating to compounds and compositions of the disclosure also apply to the pharmaceutically acceptable acid or base addition salts and all stereoisomeric forms of these compounds and compositions.

BRIEF DESCRIPTION OF THE DRAWING

FIGS. 7A and 7B. Sequences and the chemistry of various oligonucleotides: WV395 (SEQ ID NO: 262) and WV884 to WV897 (SEQ ID NOS: 263 to 276). The suffices 0.01 and 0.02 indicate batch numbers. These include stereopure (chirally pure) oligonucleotides or oligonucleotide compositions, including 2'-OMe modifications. WV-942 (SEQ ID NO: 261).

FIGS. 9A and 9B. Compositions of PS (phosphorothioates) and 2'-F on the wings of various oligonucleotides, including WV-2095 to WV-2109 (SEQ ID NOS: 423 to 437). WV-2106 to WV-2109 are hemimers. WV-1714 (SEQ ID NO: 306).

FIG. 10B shows additional data for WV-1714 (SEQ ID NO: 306). WV-1683 (SEQ ID NO: 419), a negative control in this experiment, targets mouse exon 23.

FIGS. 11A and 11B. Sequence and chemistry of various oligonucleotides, WV-1108 (SEQ ID NO: 278) and WV-2381 to WV-2395 (SEQ ID NOS: 627 to 631). These have PS (phosphorothioates) in the wings and PO (phosphodiesters) in the core. WV-1108 (SEQ ID NO: 278).

FIGS. 13A and 13B. Sequences and chemistry of various oligonucleotides, WV-2366 to WV-2370 (SEQ ID NOS: 622 to 626). These have phosphorothioates in the Sp conformation in the wings and PO (phosphodiesters) in the core.

Figure 14:
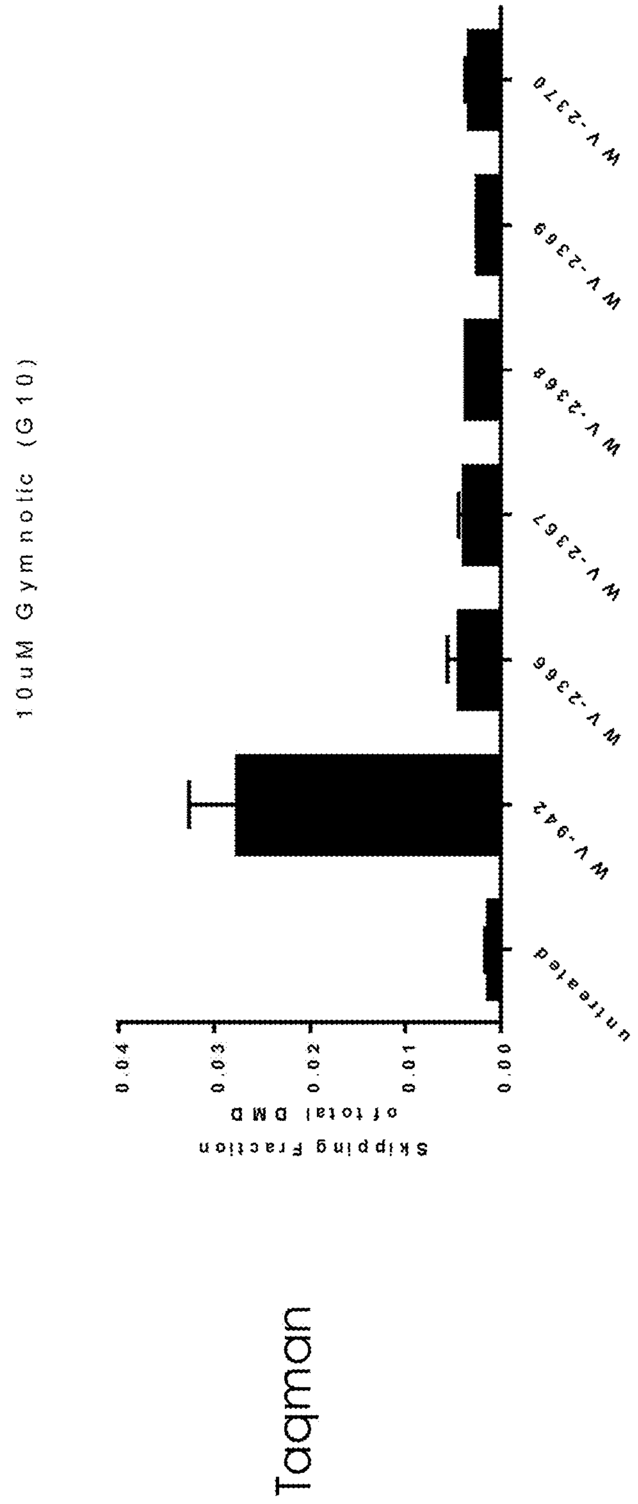

FIG. 14. Ability of various oligonucleotides to induce skipping of exon 51 of dystrophin. Controls: WV-942 and untreated; Concentration: 10 uM; Duration: 4 days in differentiation medium; Cells: Del 48-50; treatment was gymnotic (without transfection reagent).

FIG. 15. Sequences and chemistry of various oligonucleotides, which are 20-mers or 25-mers, including WV-2313 to WV-2320 (SEQ ID NOS: 569 to 576), and WV-2223 to WV-2230 (SEQ ID NO: 483 to 490).

Figure 16:
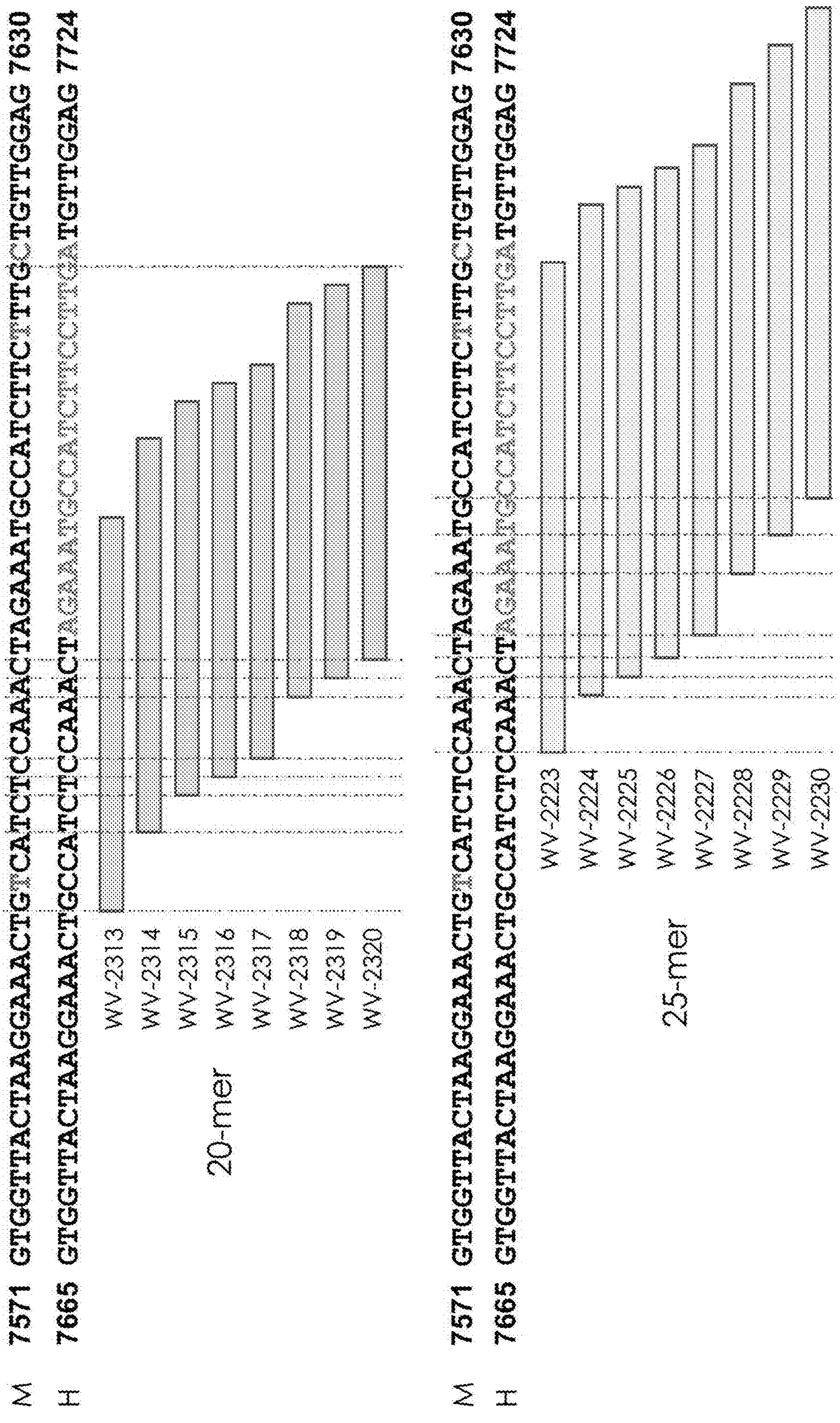

FIG. 16. Location of the sequences of various oligonucleotides, which are 20-mers or 25-mers, including WV-2313 to WV-2320, and WV-2223 to WV-2230, relative to the human (H) (SEQ ID NO: 1122) and mouse (M) (SEQ ID NO: 1121) dystrophin sequences.

Figure 17:
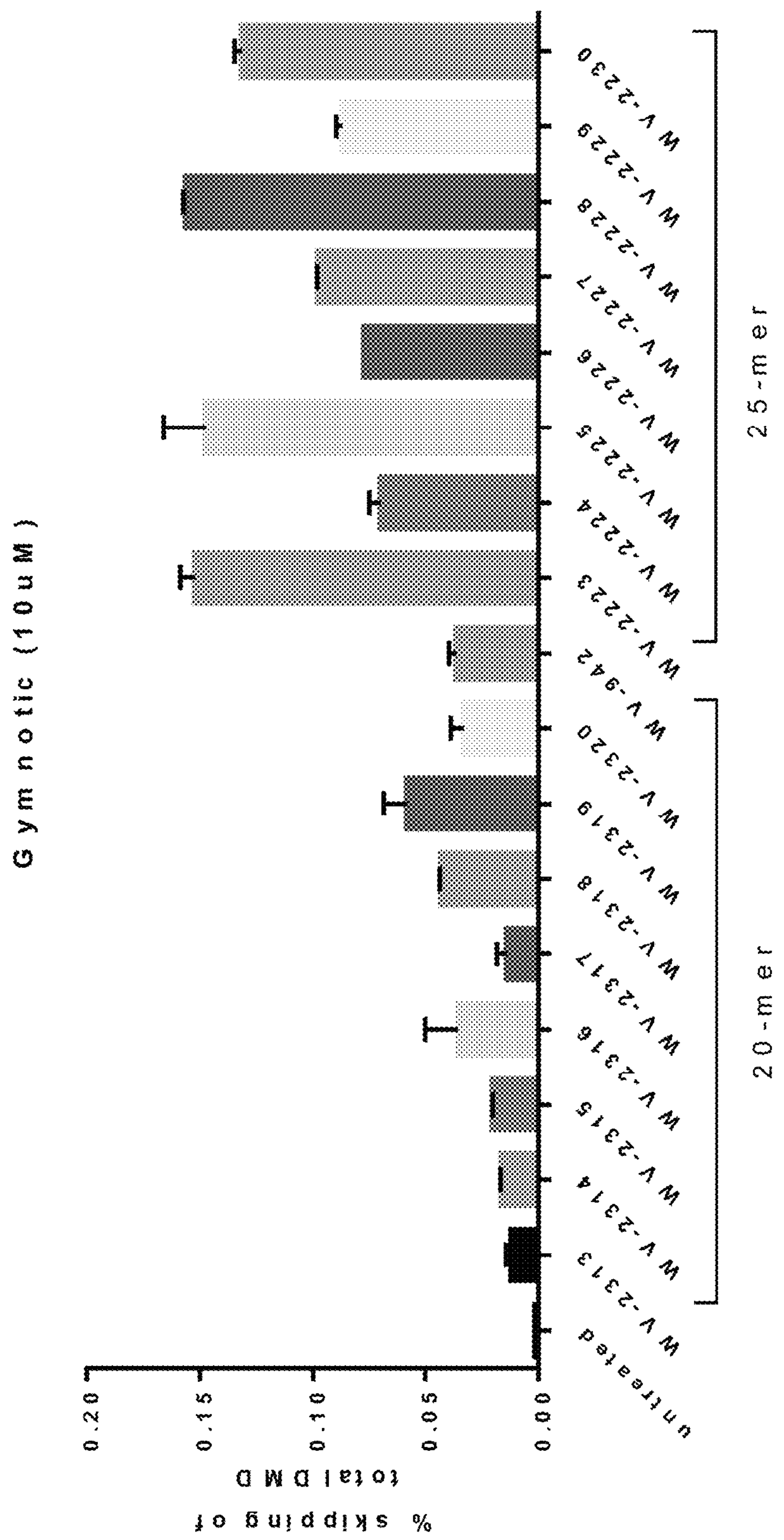

FIG. 17. Ability of various oligonucleotides to induce skipping of exon 51 of dystrophin. Controls: WV-942 and untreated; Concentration: 10 uM; Duration: 4 days in differentiation medium; Cells: Del 48-50; treatment was gymnotic (without transfection reagent).

Figure 18:
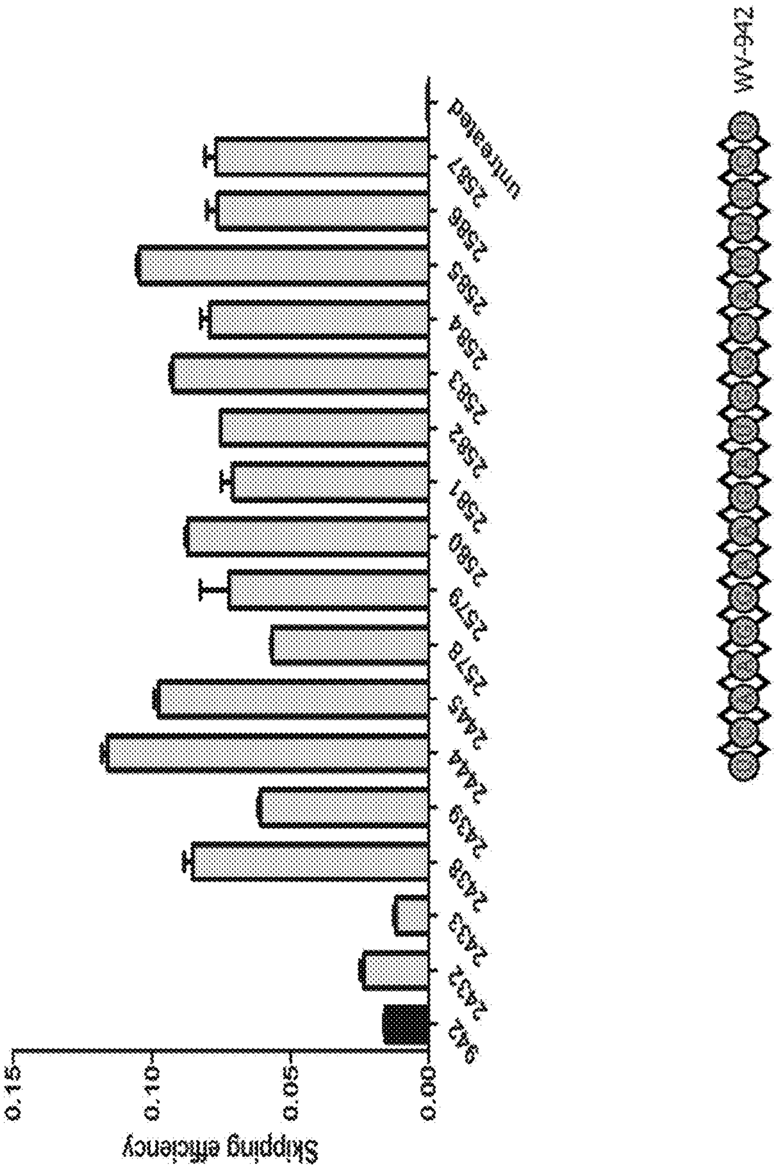

FIG. 18. Exon skipping mediated by an active compound, oligonucleotide WV-942, delivered via gymnotic delivery (not conjugated to a lipid), or conjugated to a lipid (listed in Table 5). WV-942 (SEQ ID NO: 261).

Figure 19:
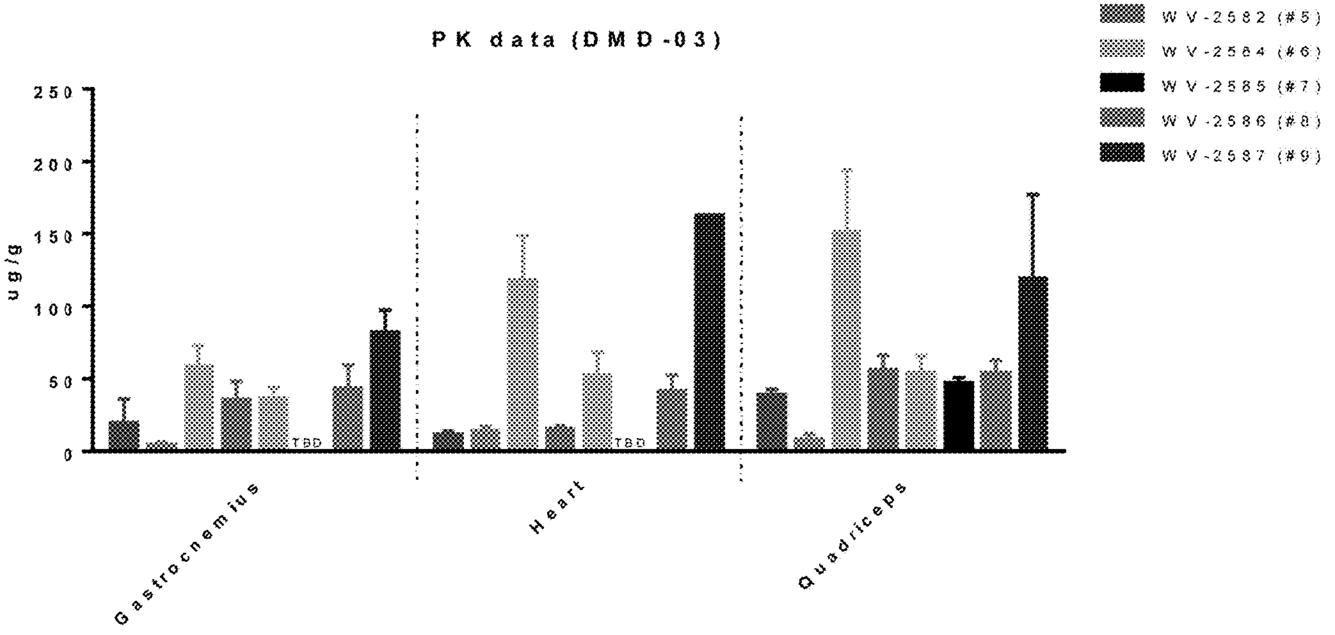

FIG. 19. In vivo pharmacokinetic (PK) data related to delivery of oligonucleotide WV-942 delivered via gymnotic delivery (not conjugated to a lipid), or conjugated to a lipid, to gastrocnemius, heart and quadriceps muscle tissues. Tested articles are listed in Table 4. From left to right: WV-942, WV-2588, WV-2581, WV-2582, WV-2584, WV-2585, WV-2586 and WV-2587.

Figure 20:
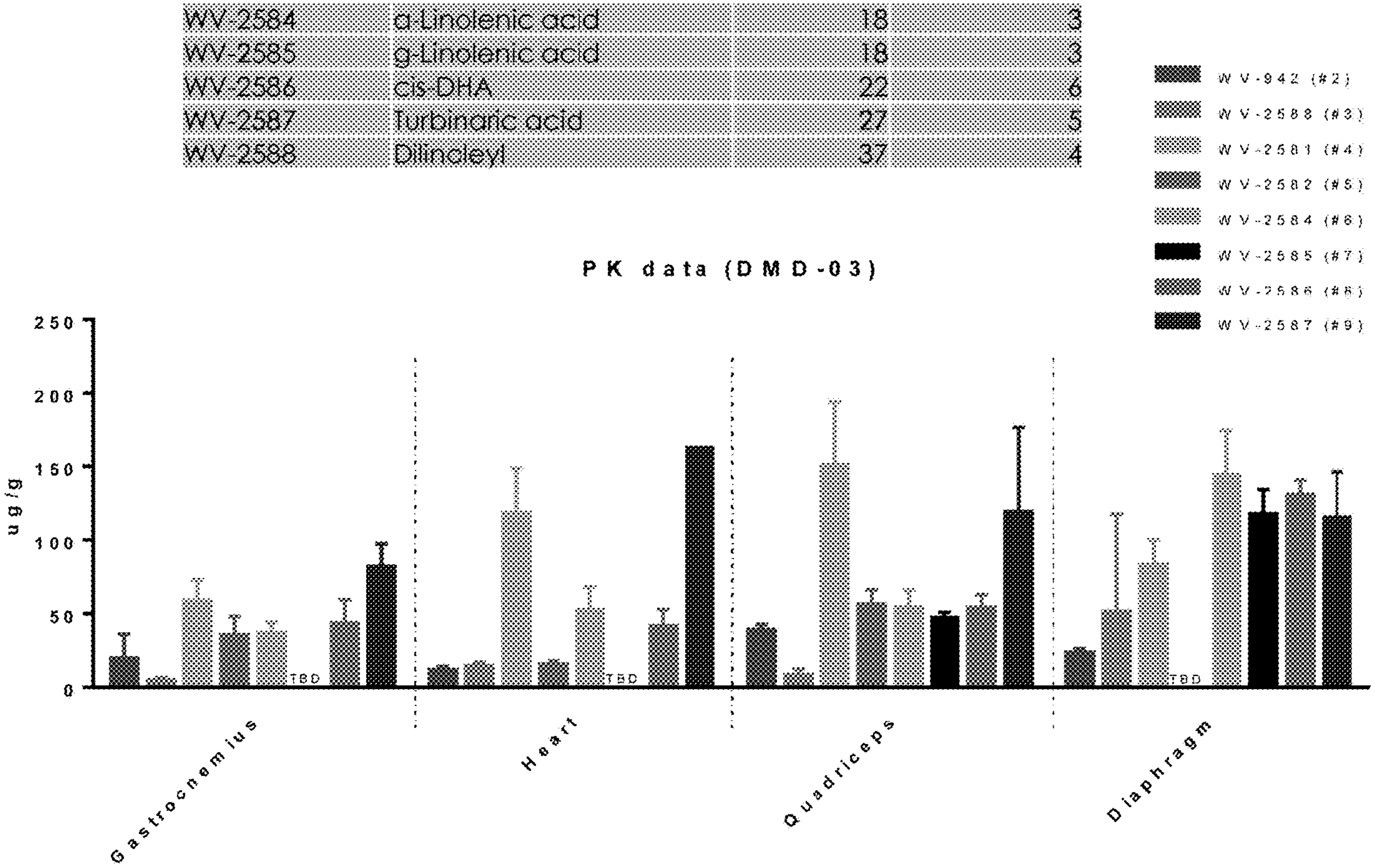

FIG. 20. In vivo pharmacokinetic (PK) data related to delivery of WV-942 delivered via gymnotic delivery (not conjugated to a lipid), or conjugated to a lipid, to gastrocnemius, heart and quadriceps and diaphragm muscle tissues. From left to right: WV-942, WV-2588, WV-2581, WV-2582, WV-2584, WV-2585, WV-2586 and WV-2587.

Figure 21:
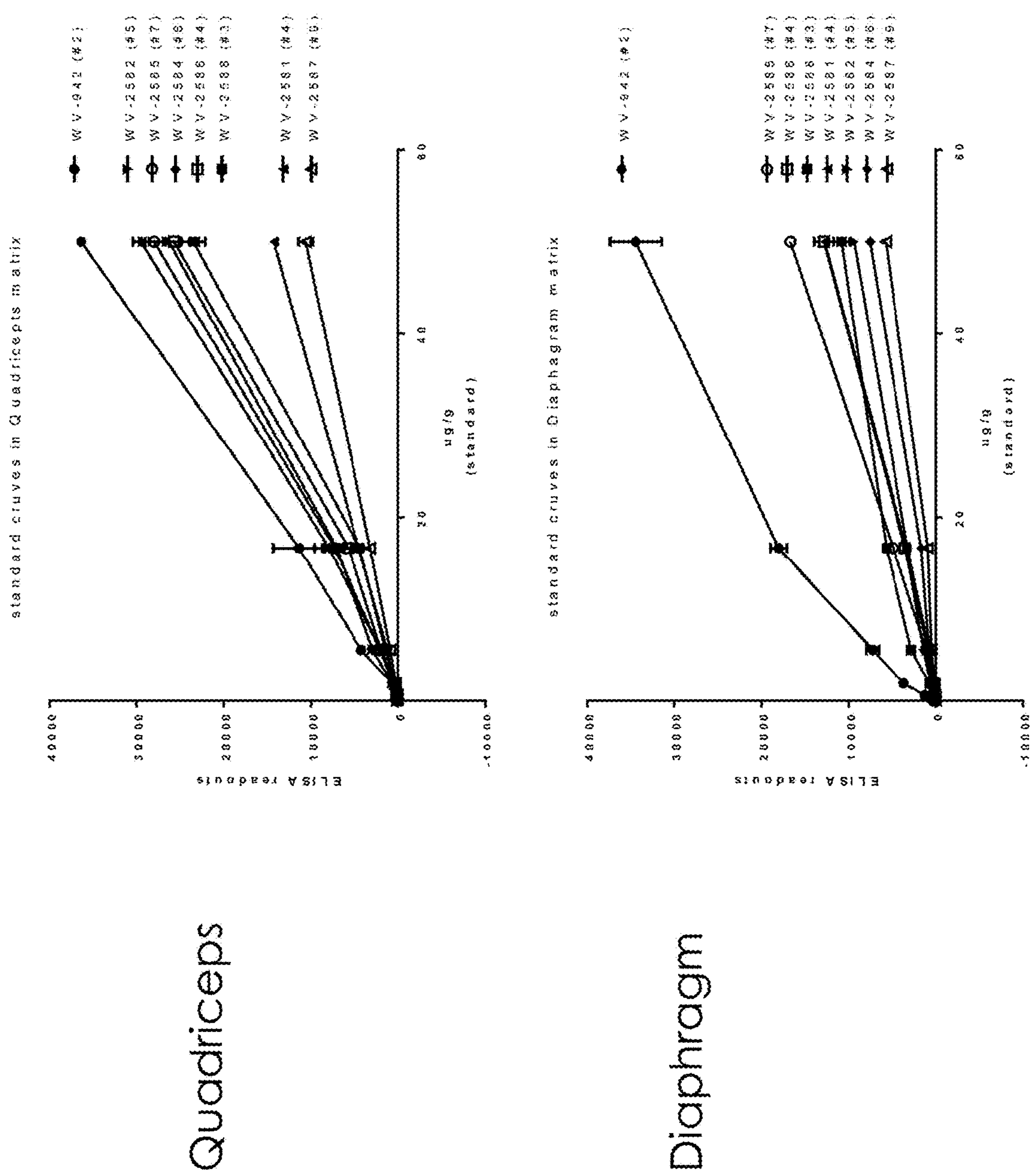

FIG. 21. Standard curves for lipid conjugates in different tissues (quadriceps and diaphragm).

Figure 22:
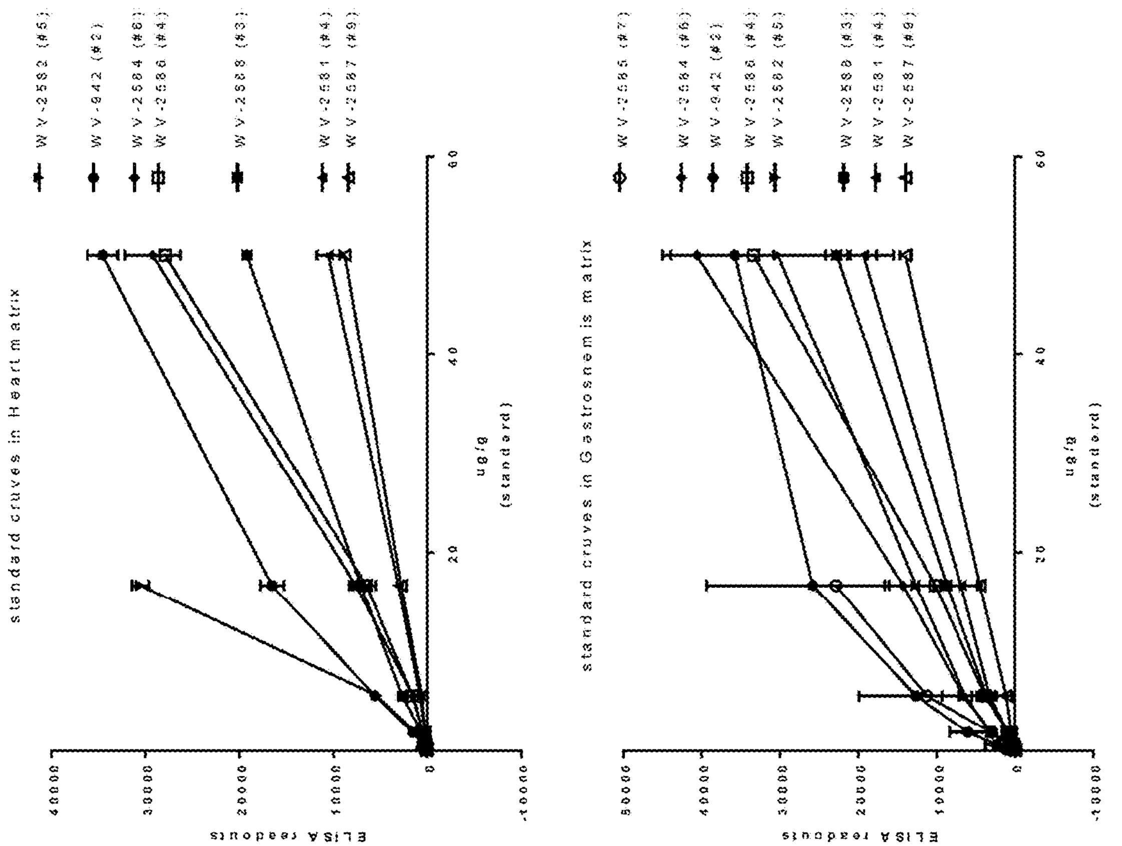

FIG. 22. Standard curves for lipid conjugates in different tissues (heart and gastrocnemius).

Figure 23:
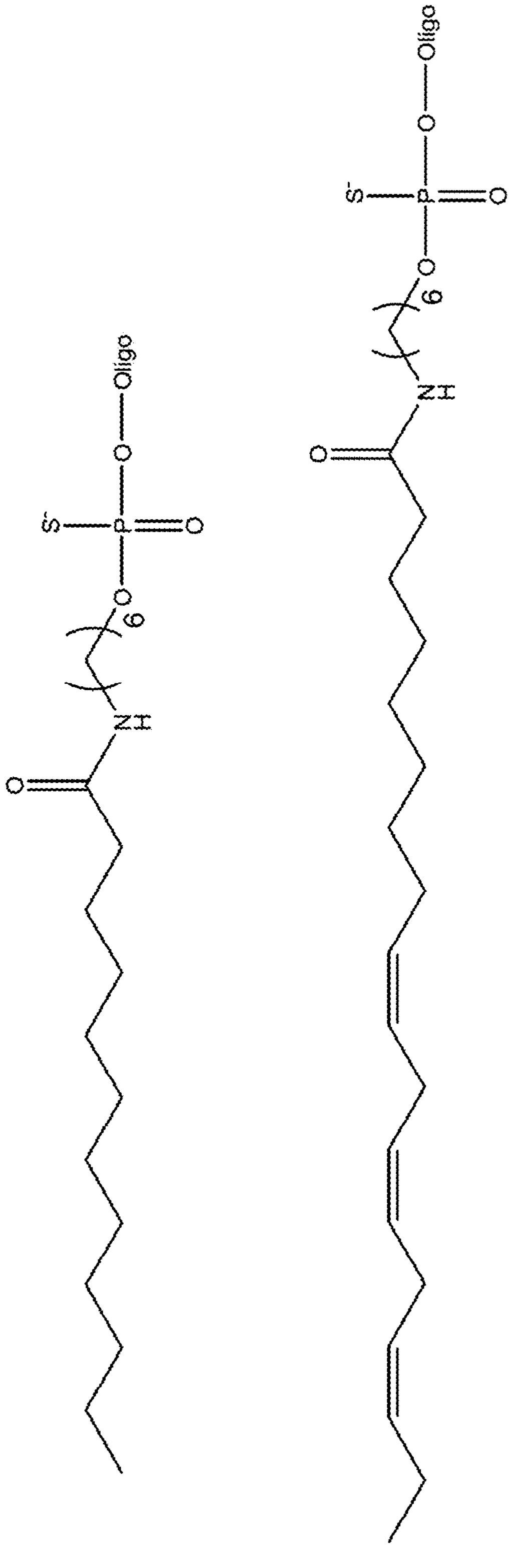

FIG. 23. Example structures of lipids and linkers for conjugation to an active compound. Abbreviation: Oligo: an example oligonucleotide.

Figure 24:
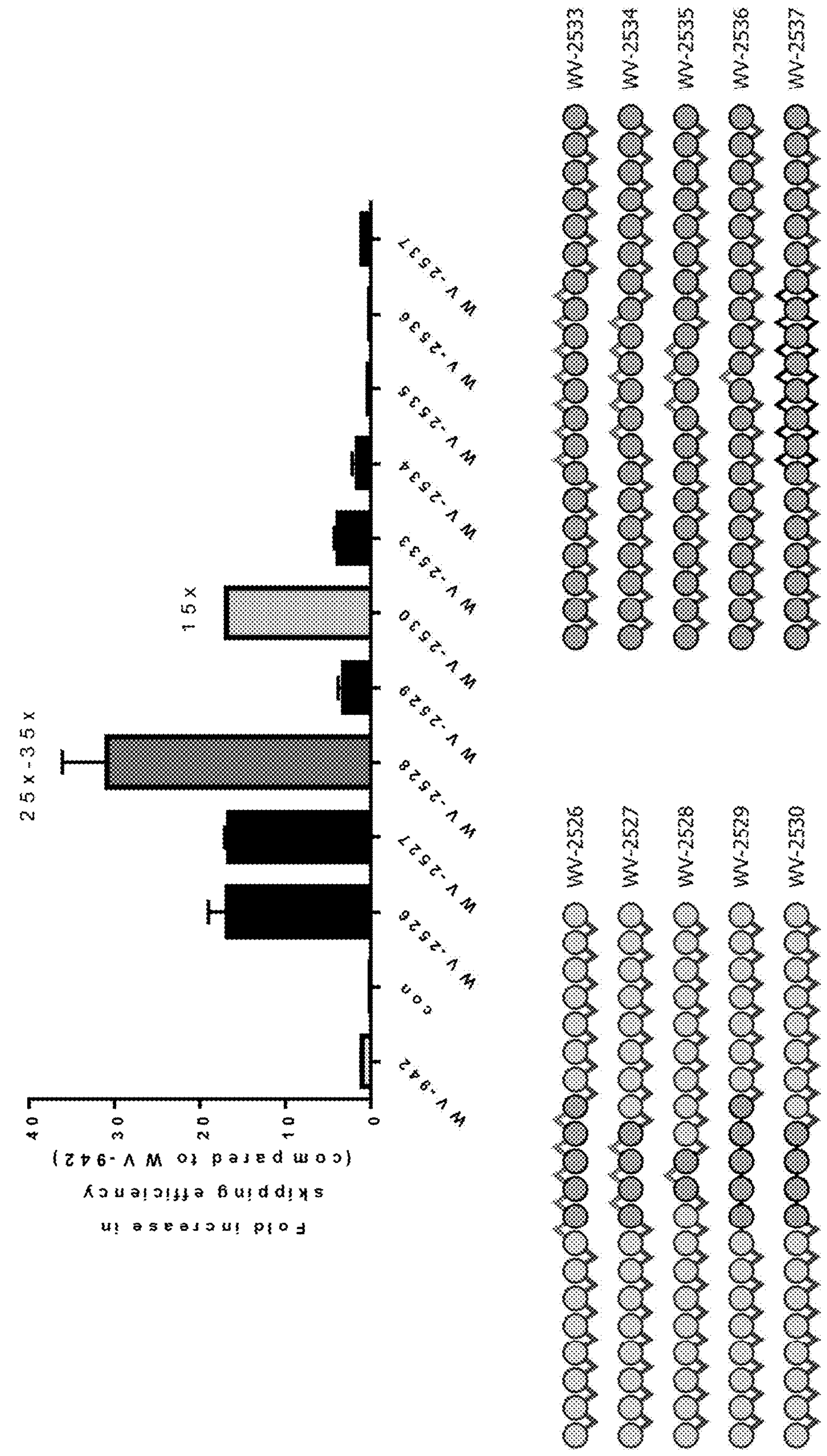

FIG. 24 shows the efficacy of stereopure oligonucleotides with 2'-F wings and either PO or Rp cores, in skipping exon 51 of human dystrophin, compared to WV-942 (Drisapersen). Treatment was 10 μM, gymnotic treatment.

Figure 25:
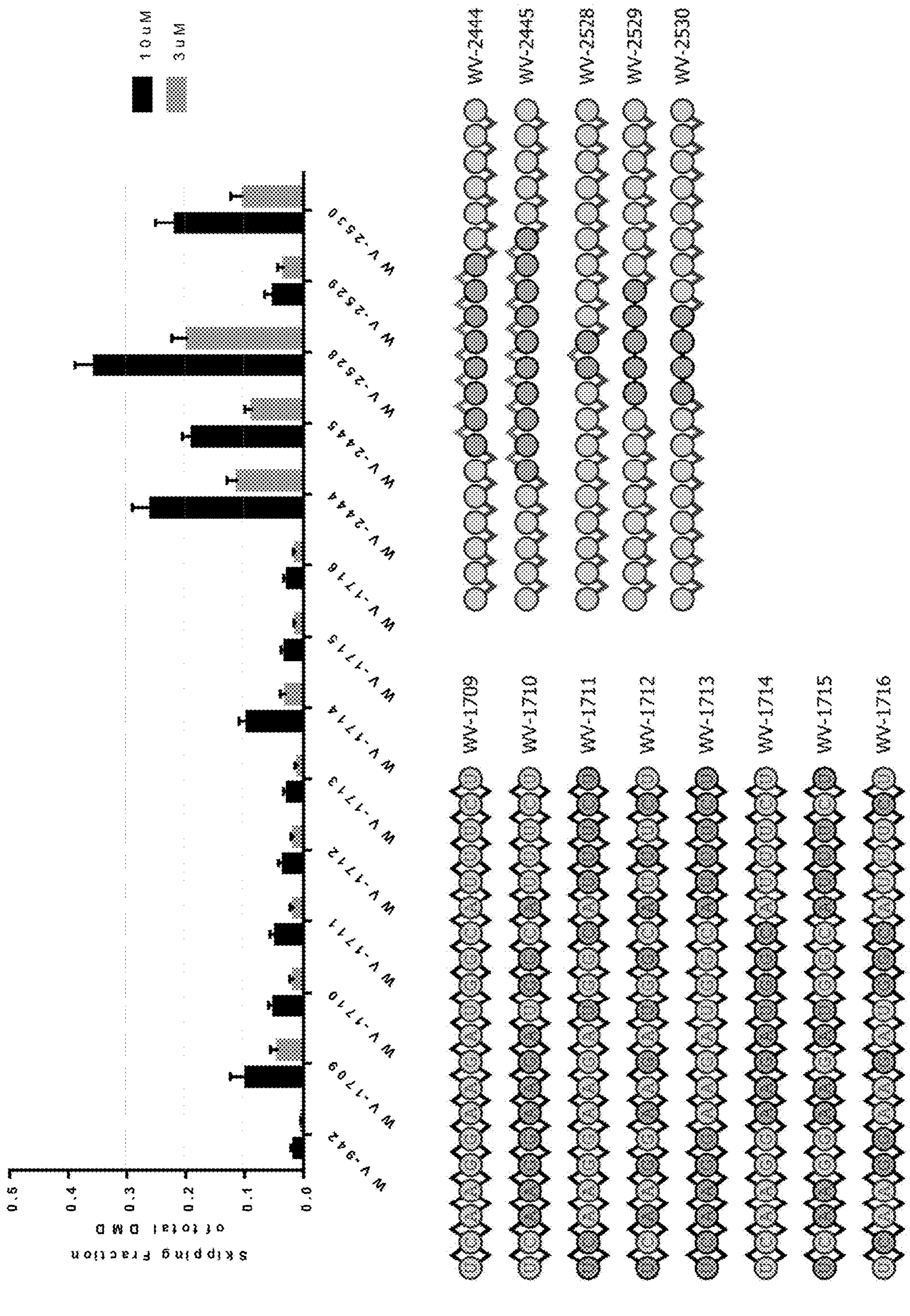

FIG. 25 shows the efficacy of stereopure oligonucleotides in skipping exon 51 of human dystrophin, compared to WV-942. Data for two different doses, 3 μM and 10 μM, are presented. On the bottom left are stereorandomers with different patterns of 2'-F and 2'-OMe modifications. On the bottom right are stereopure oligonucleotides. WV-1709 to WV-1716 (SEQ ID NOS: 301 to 308).

Figure 26:
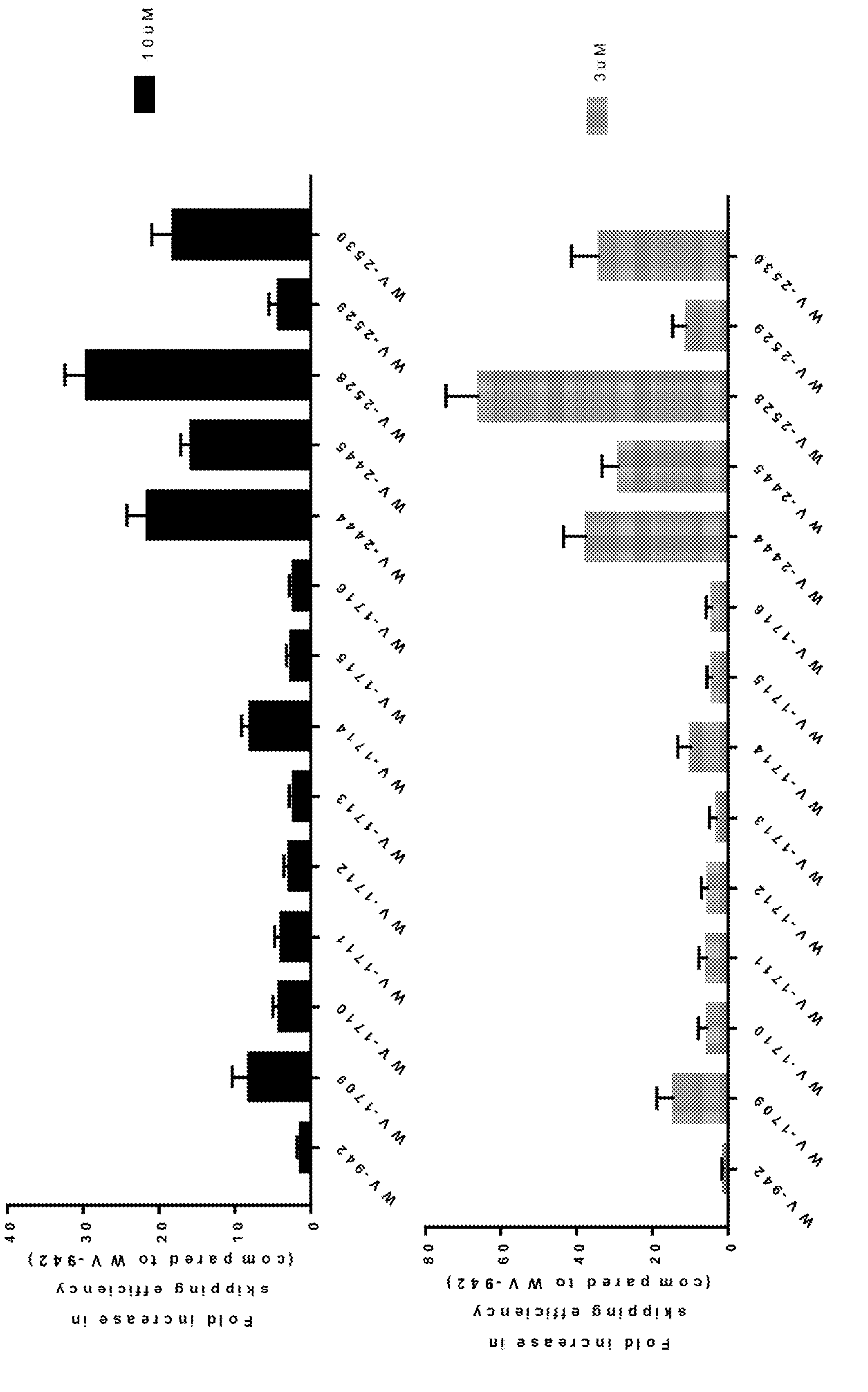

FIG. 26 shows the efficacy of various oligonucleotides; shown are fold-changes compared to WV-942. Data for two different doses, 3 μM and 10 μM, are presented.

Figure 27G:
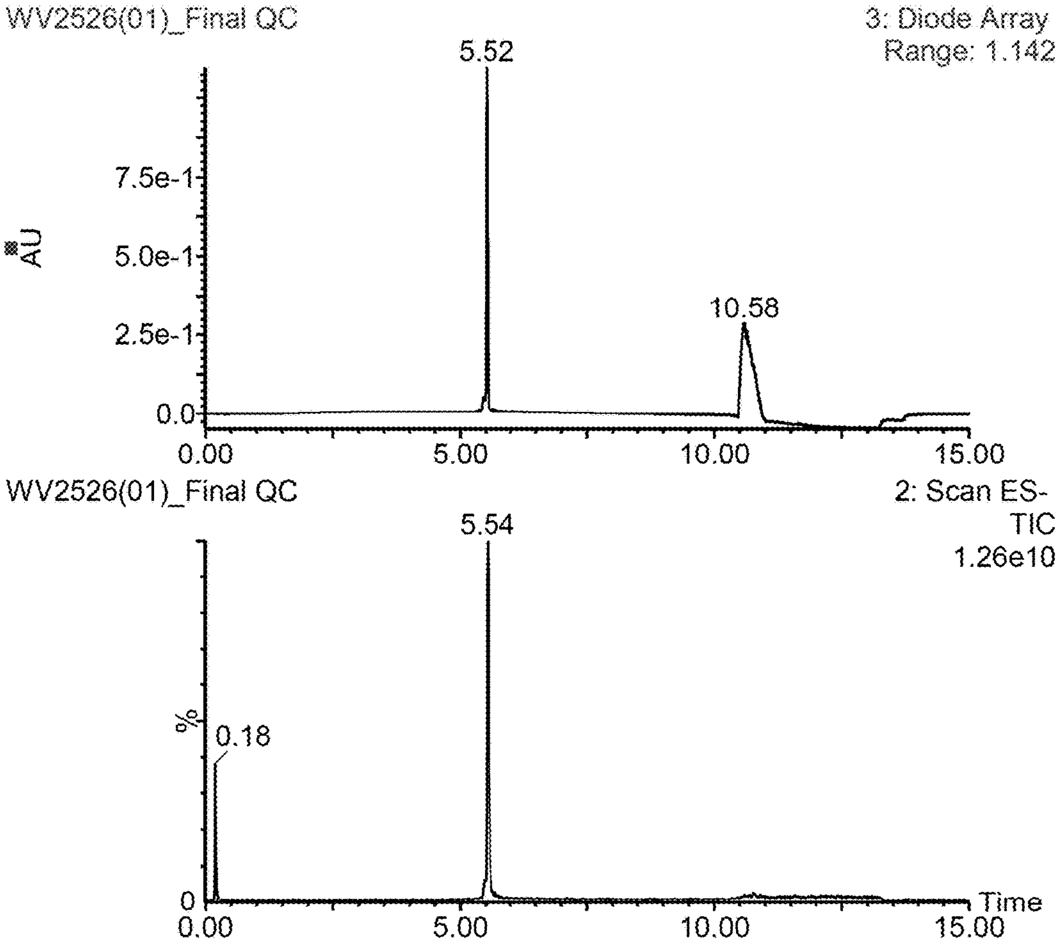
Figure 27I:
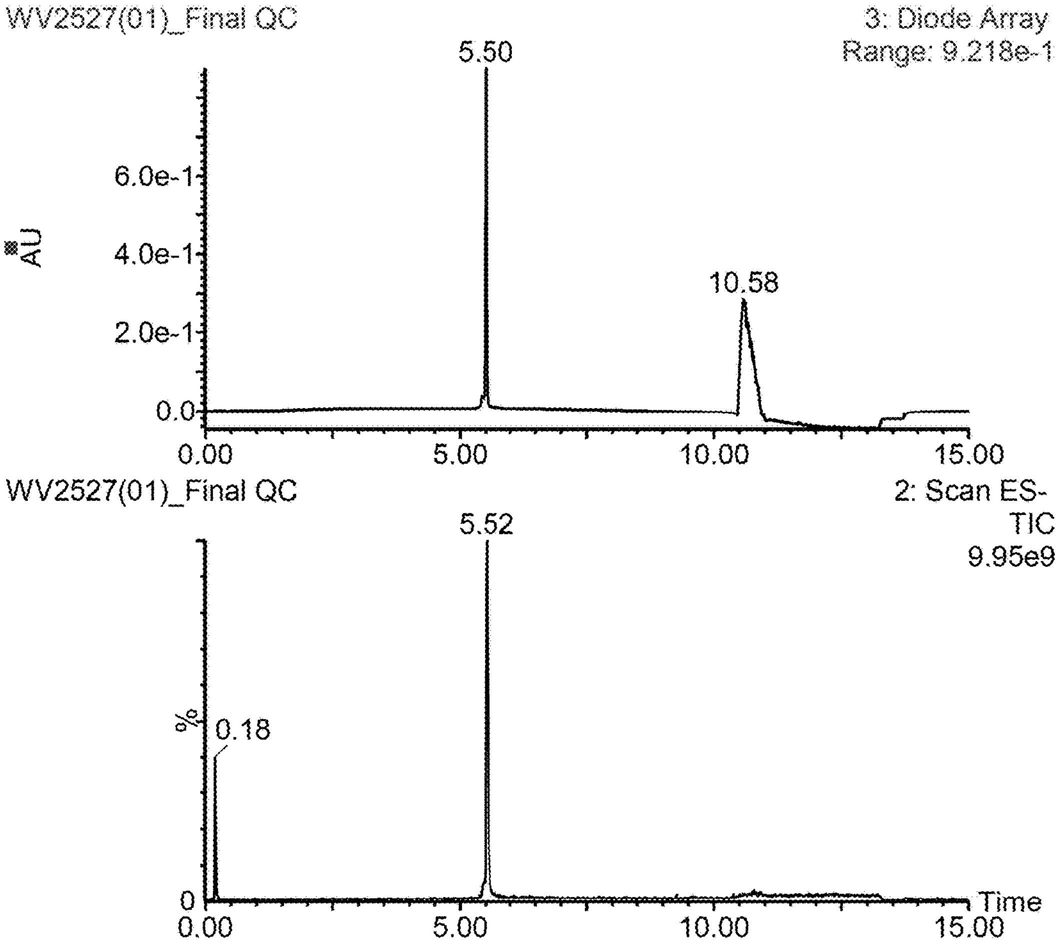
Figure 27K:
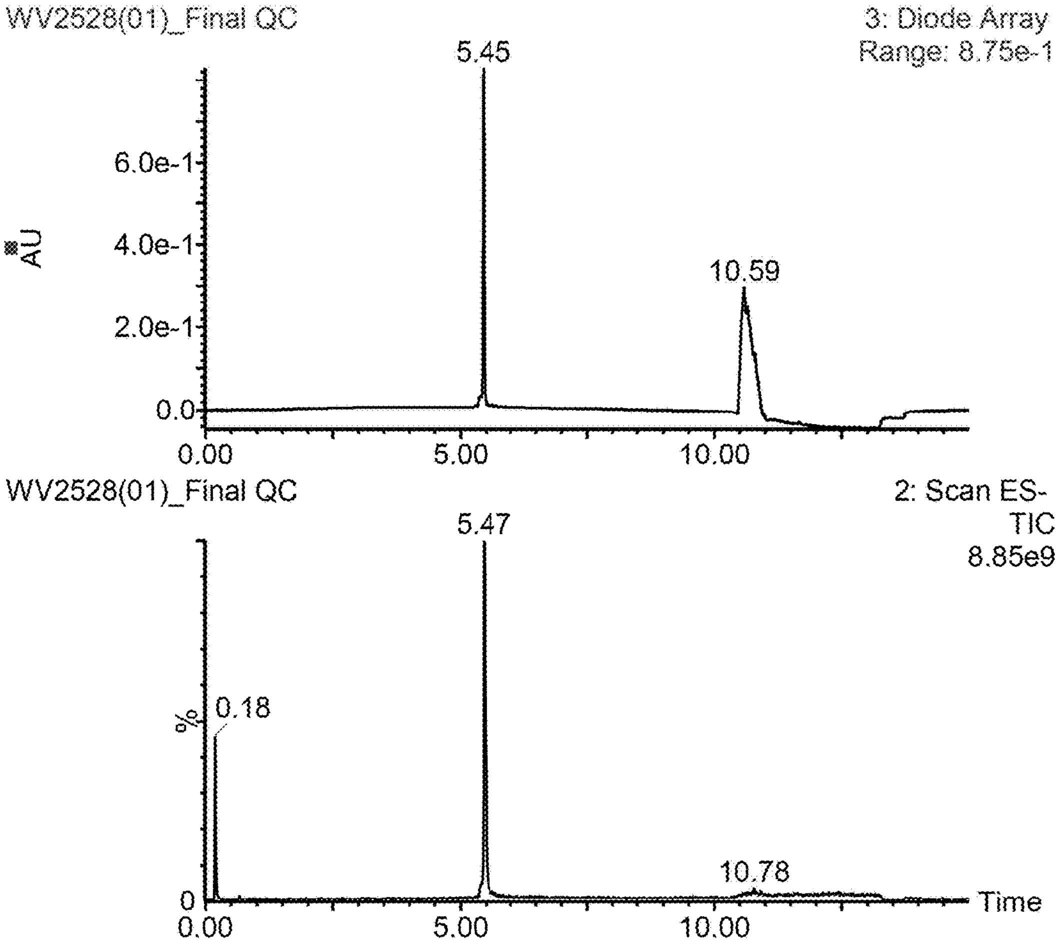
Figure 27M:
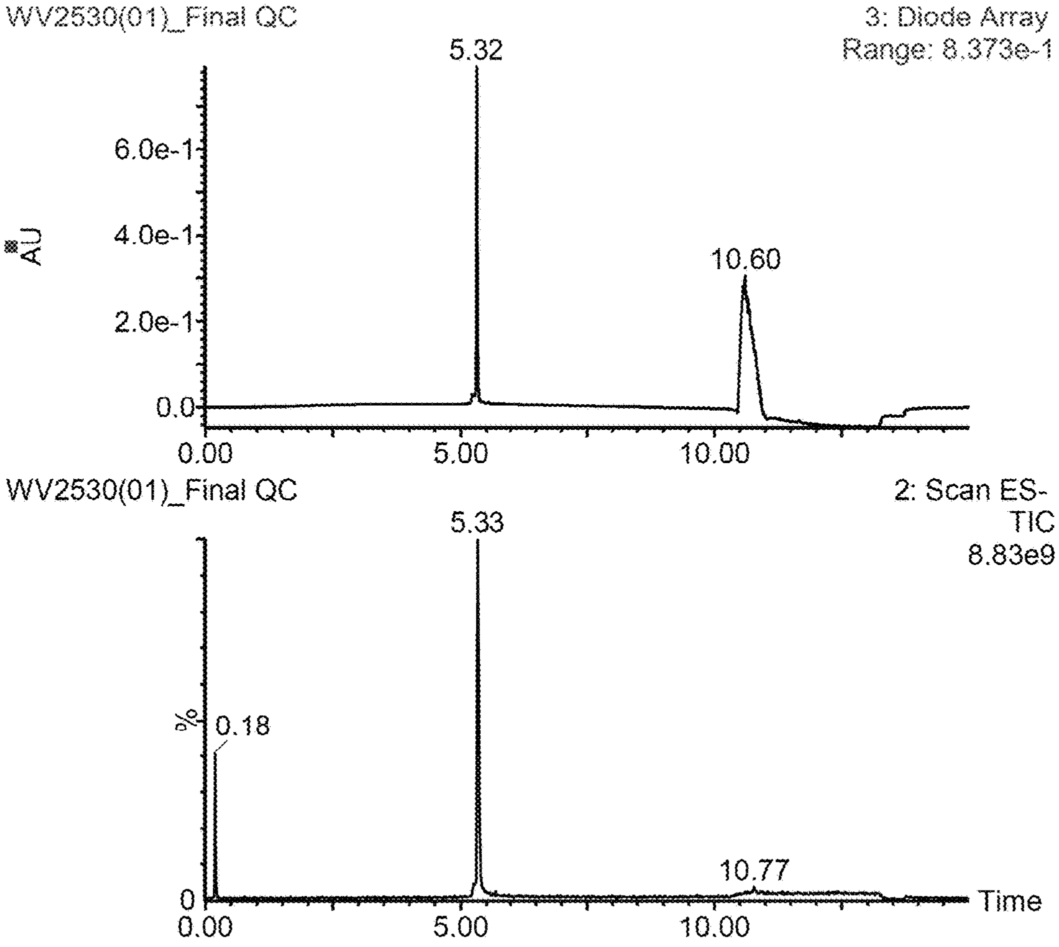

FIGS. 27A to 27O shows liquid chromatograph and mass spectra data for oligonucleotides: WV887, WV892, WV896, WV1714, WV2444, WV2445, WV2526, WV2527, WV2528, and WV2530. The suffices (01), (02), 0.01 and 0.02 indicate batch numbers.

Figure 28:
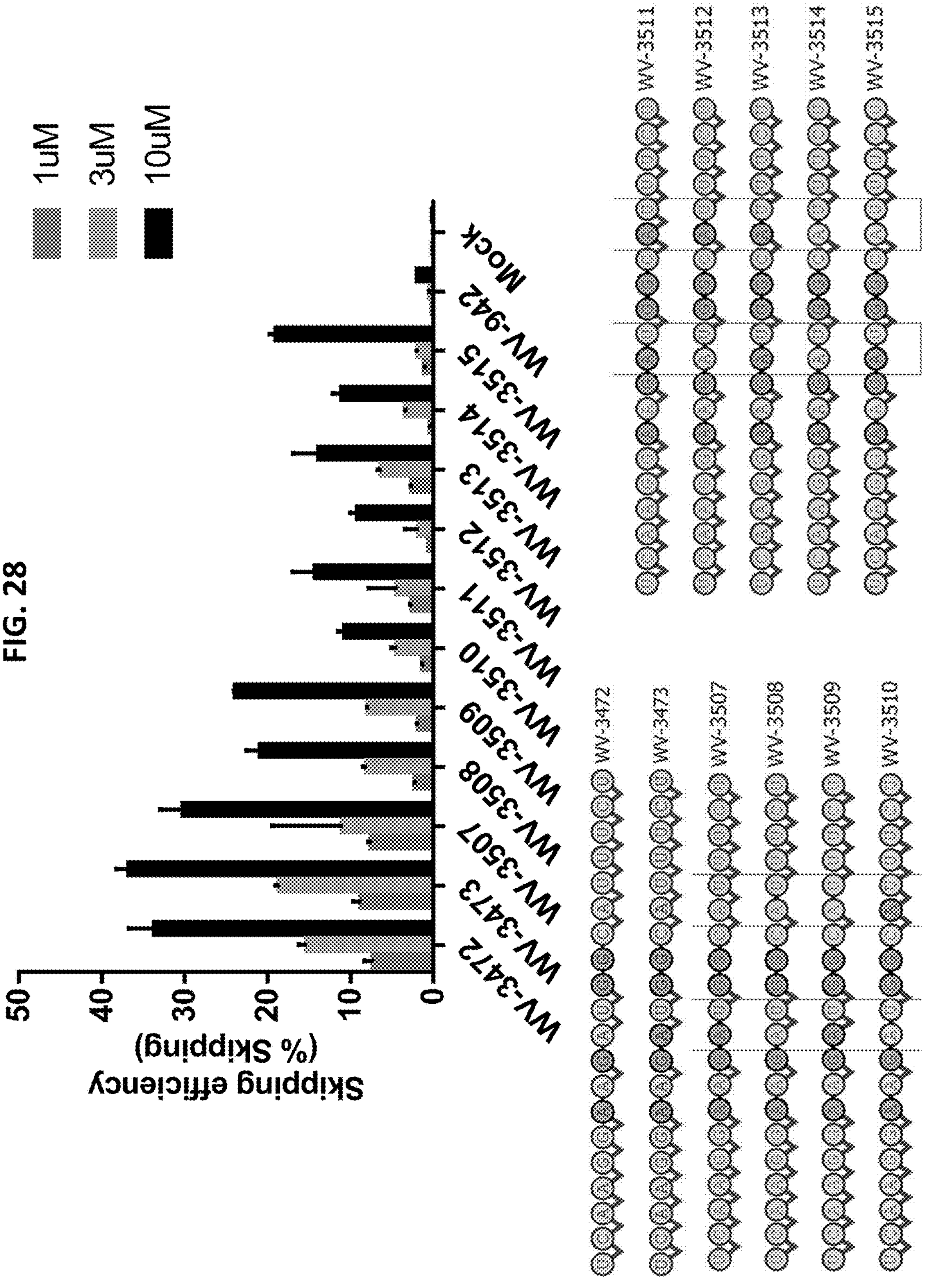

FIG. 28 shows example skipping efficiency of certain provided chirally controlled oligonucleotide compositions in skipping exon 51 of human dystrophin, compared to WV-942. Data for three different doses, 1 μM, 3 μM and 10 μM, are presented. Skipping efficiency generally increases with increased concentration. Treatment was gymnotic (without transfection reagent). WV-3472 (SEQ ID NO: 819), WV-3473 (SEQ ID NO: 820), WV-3507 to WV-3515 (SEQ ID NOS: 822-830).

Figure 29:
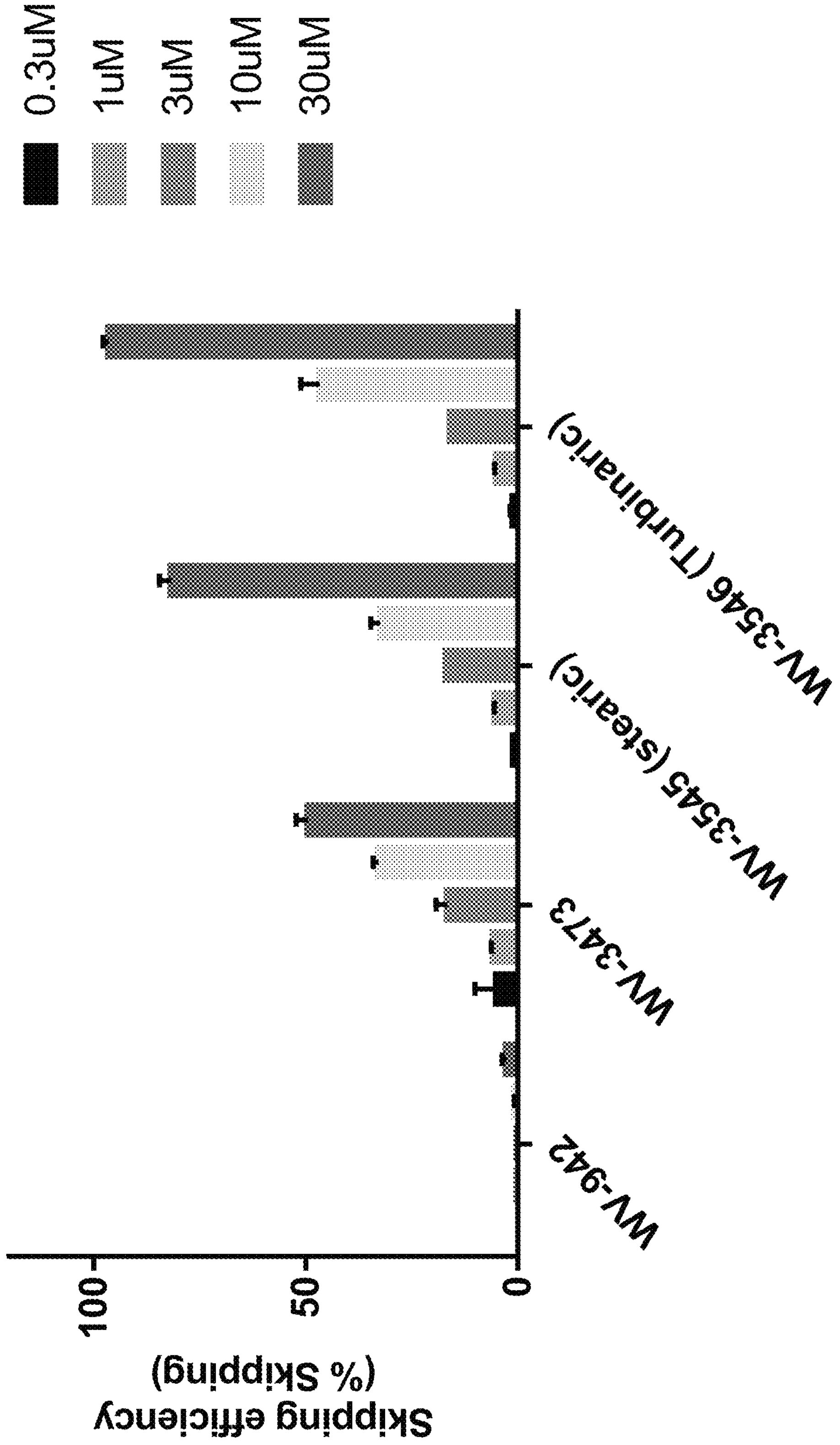

FIG. 29 shows example skipping efficiency of certain provided chirally controlled oligonucleotide compositions in skipping exon 51 of human dystrophin, compared to WV-942. Data for different doses from 0.3 μM to 30 μM, are presented. Skipping efficiency generally increases with increased concentration. WV-3545 (WV-3473 conjugated to stearic acid by PO and C6 amino linker) and WV-3546 (WV-3473 conjugated to turbinaric acid by PO and C6 amino linker), both containing oligonucleotide-lipid conjugates, demonstrated higher efficiency. Treatment was gymnotic (without transfection reagent). The experiment was done in triplicate, with average data shown.

Figure 30:
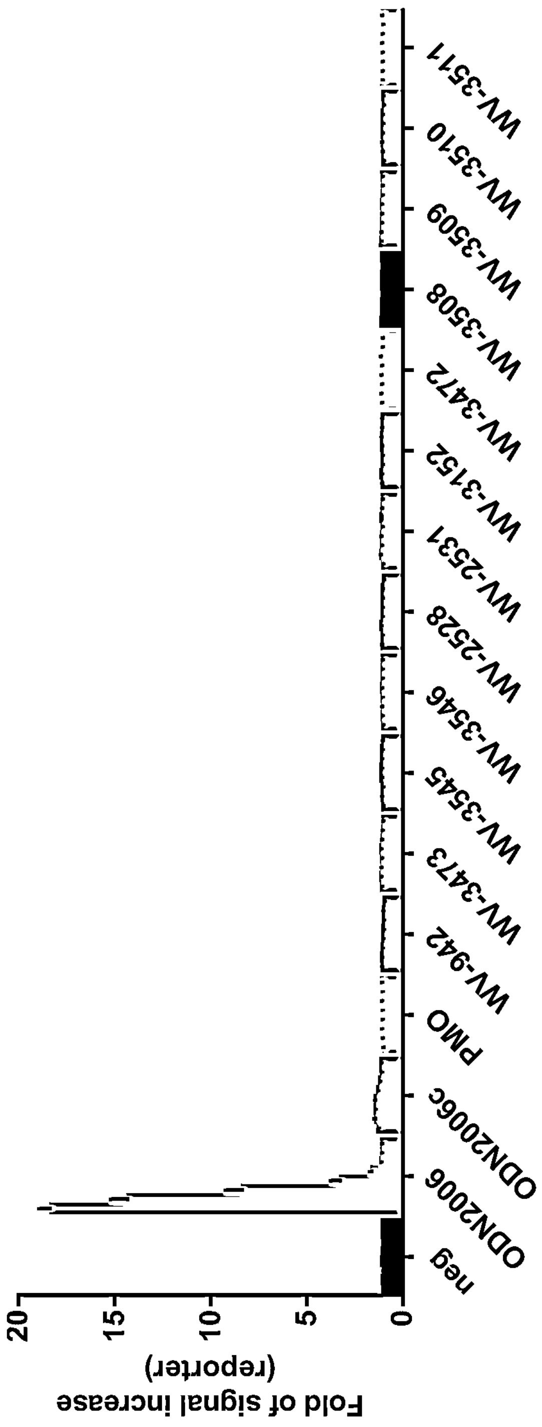

FIG. 30 shows that several example provided oligonucleotides do not have hTLR9 agonist activity under the tested conditions. The experiment was done in triplicate, with average data shown.

Figure 31:
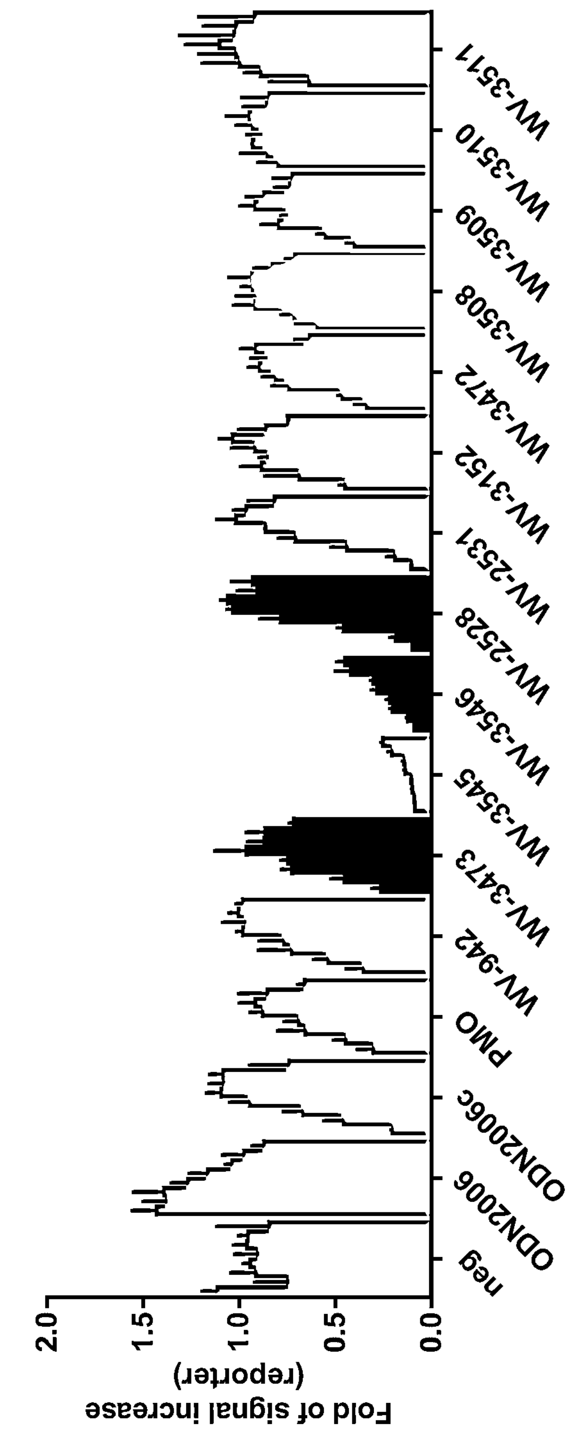

FIG. 31 shows that various provided oligonucleotides can counteract the hTLR9 agonistic activity of oligonucleotide ODN2006 (and to antagonize hTLR9). As demonstrated, conjugates of lipids (e.g., stearic acid (WV-3545) or turbinaric acid (WV-3546)) and oligonucleotides (e.g., WV-3473 (WV-3545 and WV-3546)) have significantly increased hTLR9 antagonistic activities. The concentration of agonistic oligonucleotide ODN2006 was held constant at 0.3 μM. Each oligonucleotide was tested at decreasing concentrations of: 5, 2.5, 1.25, 0.6, 0.3, 0.15 and 0.075 μM (from left to right). Treatment was gymnotic (without transfection reagent). The experiment was done in triplicate, with average data shown.

Figure 32:
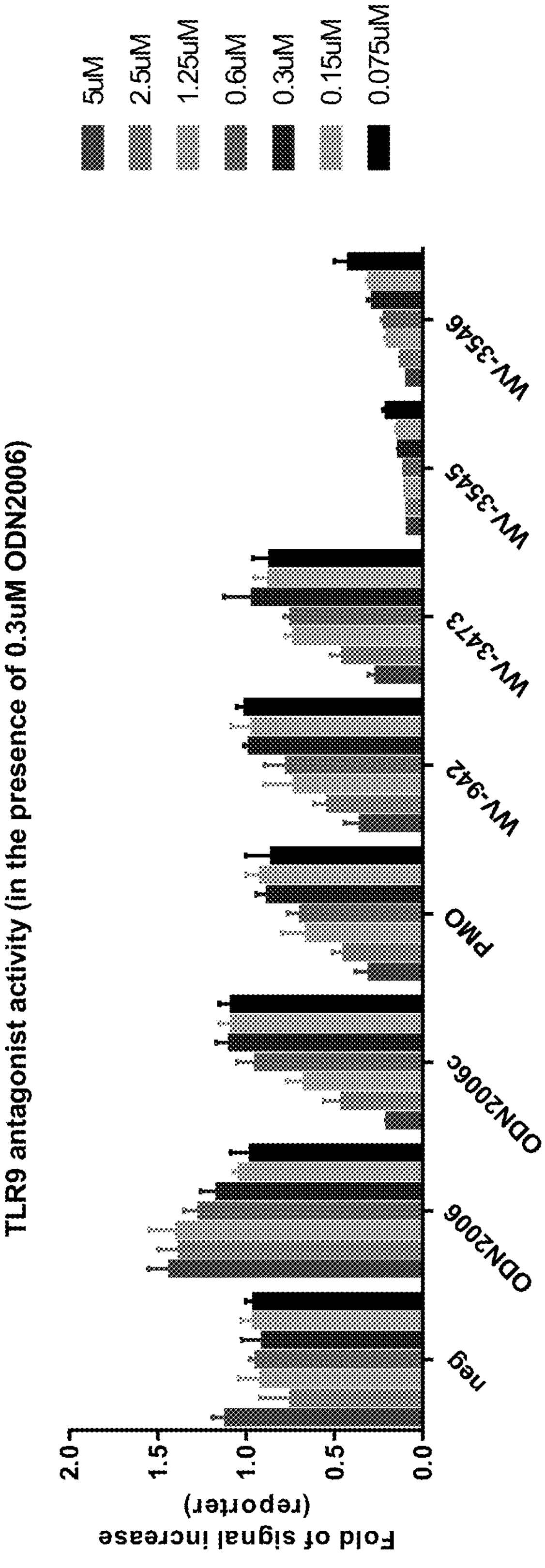

FIG. 32 shows that various oligonucleotides can counteract the hTLR9 agonistic activity of oligonucleotide ODN2006 (and to antagonize hTLR9). As demonstrated, conjugates of lipids (e.g., stearic acid (WV-3545) or turbinaric acid (WV-3546)) and oligonucleotides (e.g., WV-3473 (WV-3545 and WV-3546)) have significantly increased hTLR9 antagonistic activities. neg: negative control (buffer only). ODN2006c: an agonistic control in which the CpG sequence is replaced by GpC. PMO: Eteplirsen. The concentration of agonistic oligonucleotide ODN2006 was held constant at 0.3 μM. Each oligonucleotide was tested at decreasing concentrations of: 5, 2.5, 1.25, 0.6, 0.3, 0.15 and 0.075 μM (from left to right). Treatment was gymnotic (without transfection reagent). The experiment was done in triplicate, with average data shown.

Figure 33:
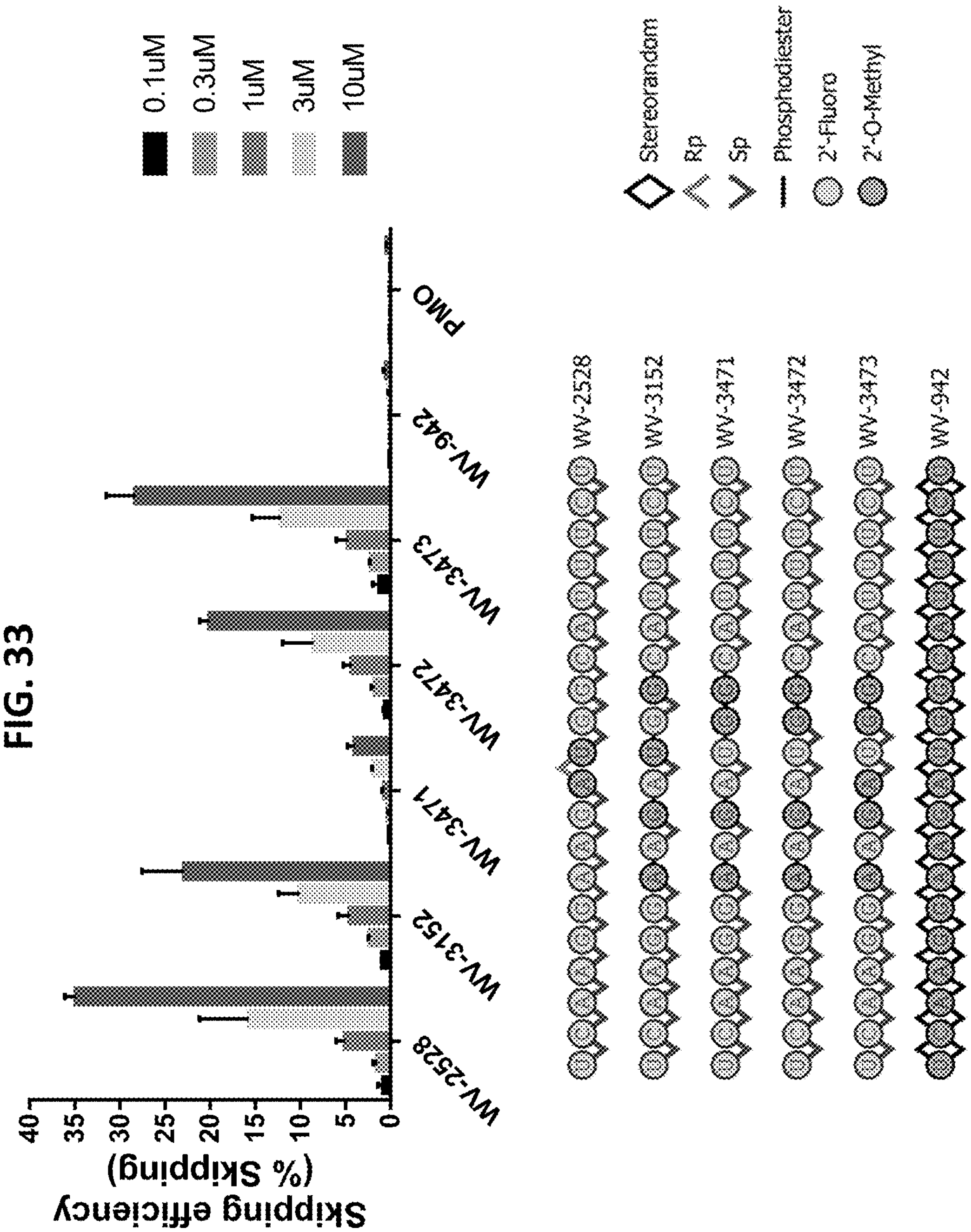

FIG. 33 shows example skipping efficiency of certain provided chirally controlled oligonucleotide compositions in skipping exon 51 of human dystrophin, compared to WV-942 and PMO (Eteplirsen). Skipping efficiency generally increases with increased concentration. Data for different doses from 0.1 μM to 10 μM are presented. DMD del48-50 cells were used. Treatment was gymnotic (without transfection reagent). WV-2528 (SEQ ID NO: 652), WV-3152 (SEQ ID NO: 798), WV-3471 (SEQ ID NO: 818), WV-3472 (SEQ ID NO: 819), WV-3473 (SEQ ID NO: 820), and WV-942 (SEQ ID NO: 261).

Figure 34:
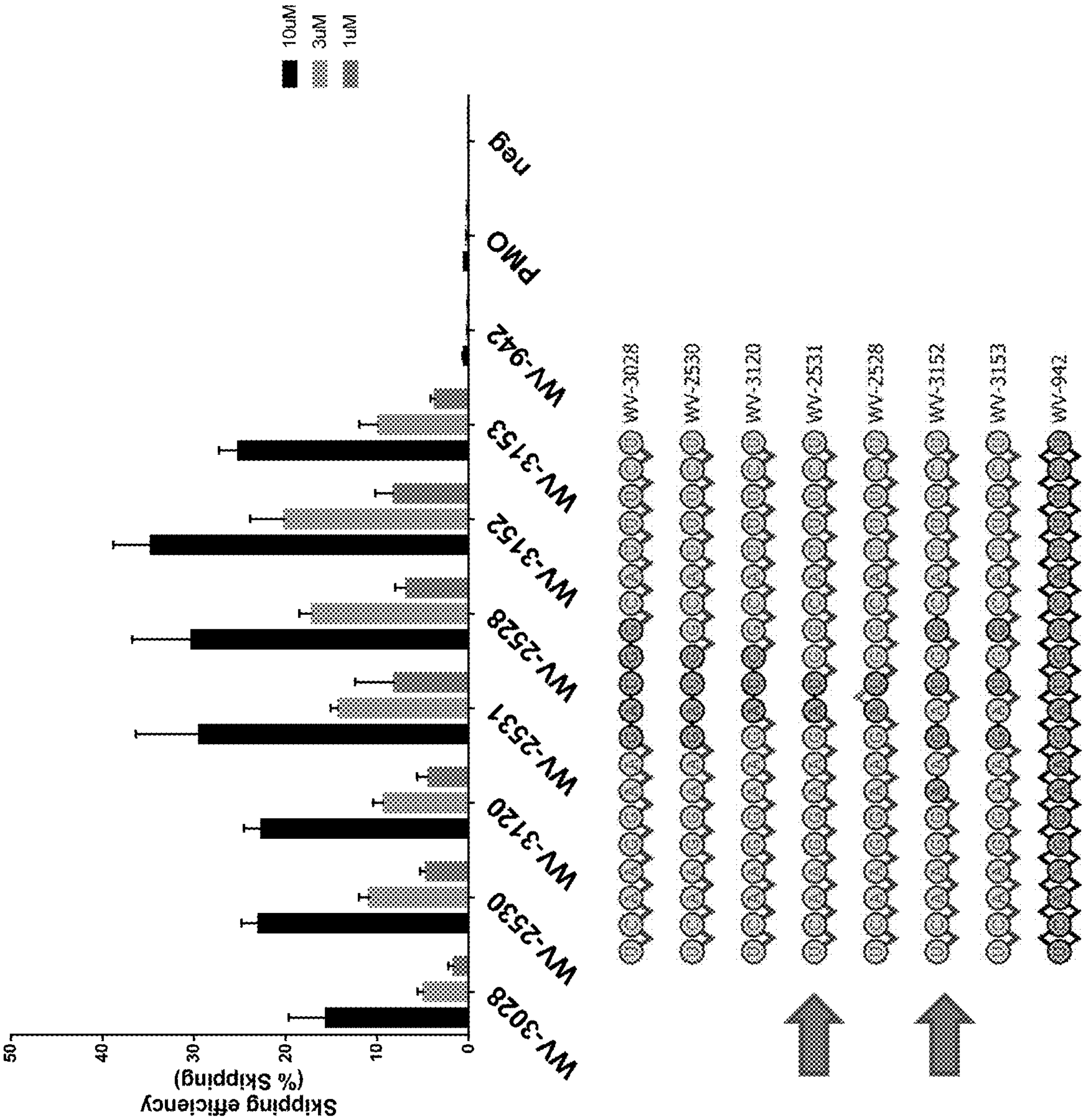

FIG. 34 shows example skipping efficiency of certain provided chirally controlled oligonucleotide compositions in skipping exon 51 of human dystrophin, compared to WV-942 and PMO (Eteplirsen). Skipping efficiency generally increases with increased concentration. Data for three different doses, 1 μM, 3 μM and 10 μM, are presented. DMD del48-50 cells were used. Treatment was gymnotic (without transfection reagent). neg: negative control. WV-3028 (SEQ ID NO: 736), WV-2530 (SEQ ID NO: 654), WV-3120 (SEQ ID NO: 796), WV-2531 (SEQ ID NO: 655), WV-2528 (SEQ ID NO: 652), WV-3152 (SEQ ID NO: 798), WV-3153 (SEQ ID NO: 799), and WV-942 (SEQ ID NO: 261).

Figure 35:
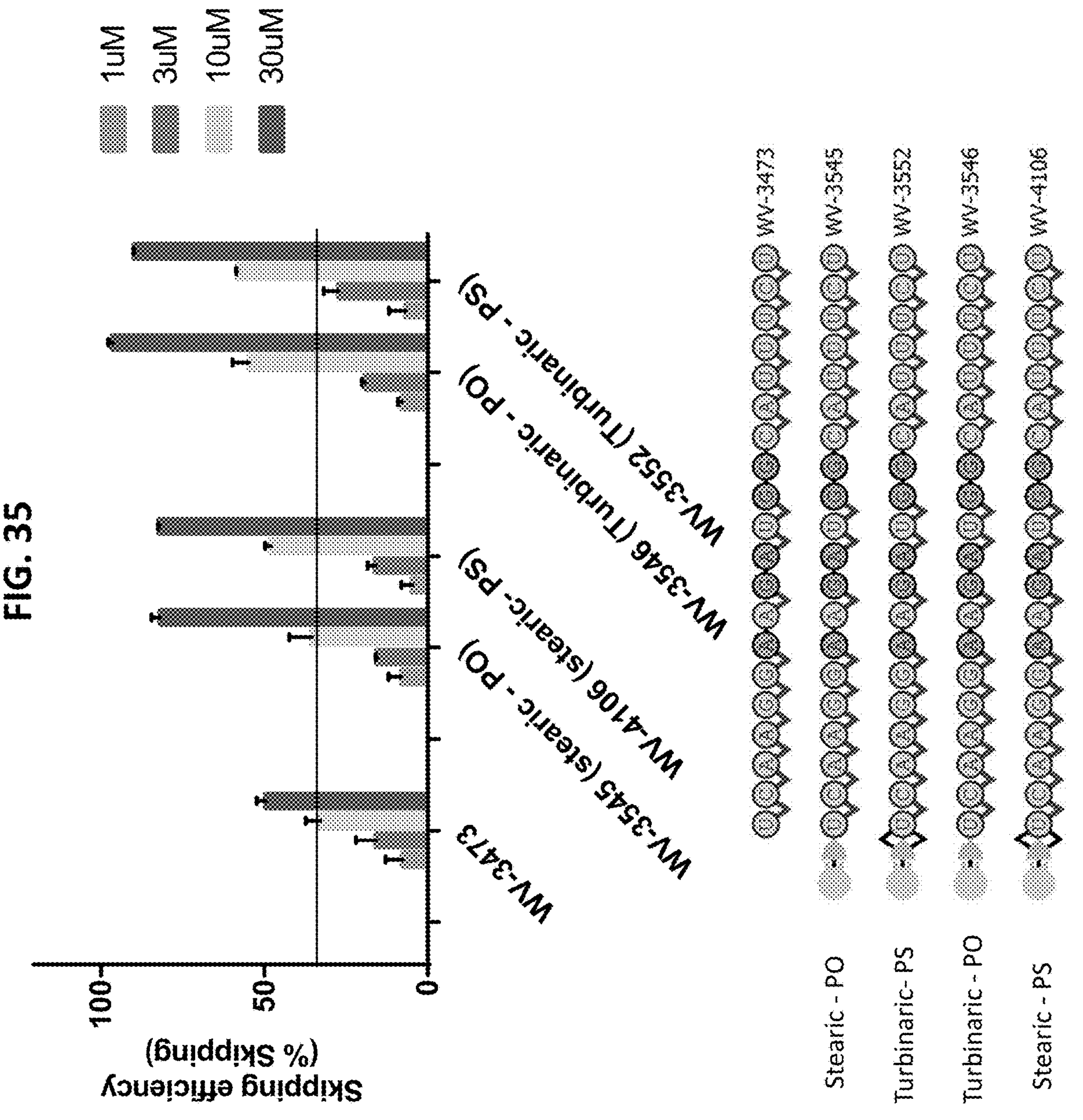

FIG. 35 shows example skipping efficiency of certain provided chirally controlled oligonucleotide compositions in skipping exon 51 of human dystrophin. Skipping efficiency generally increases with increased concentration. Data for four different doses, 1 μM, 3 μM, 10 μM and 10 μM are presented. DMD del48-50 cells were used. Treatment was gymnotic (without transfection reagent). WV-3473 (SEQ ID NO: 820), WV-3545 (SEQ ID NO: 838), WV-3552 (SEQ ID NO: 845), WV-3546 (SEQ ID NO: 839), and WV-4106 (SEQ ID NO: 868).

Figure 36:
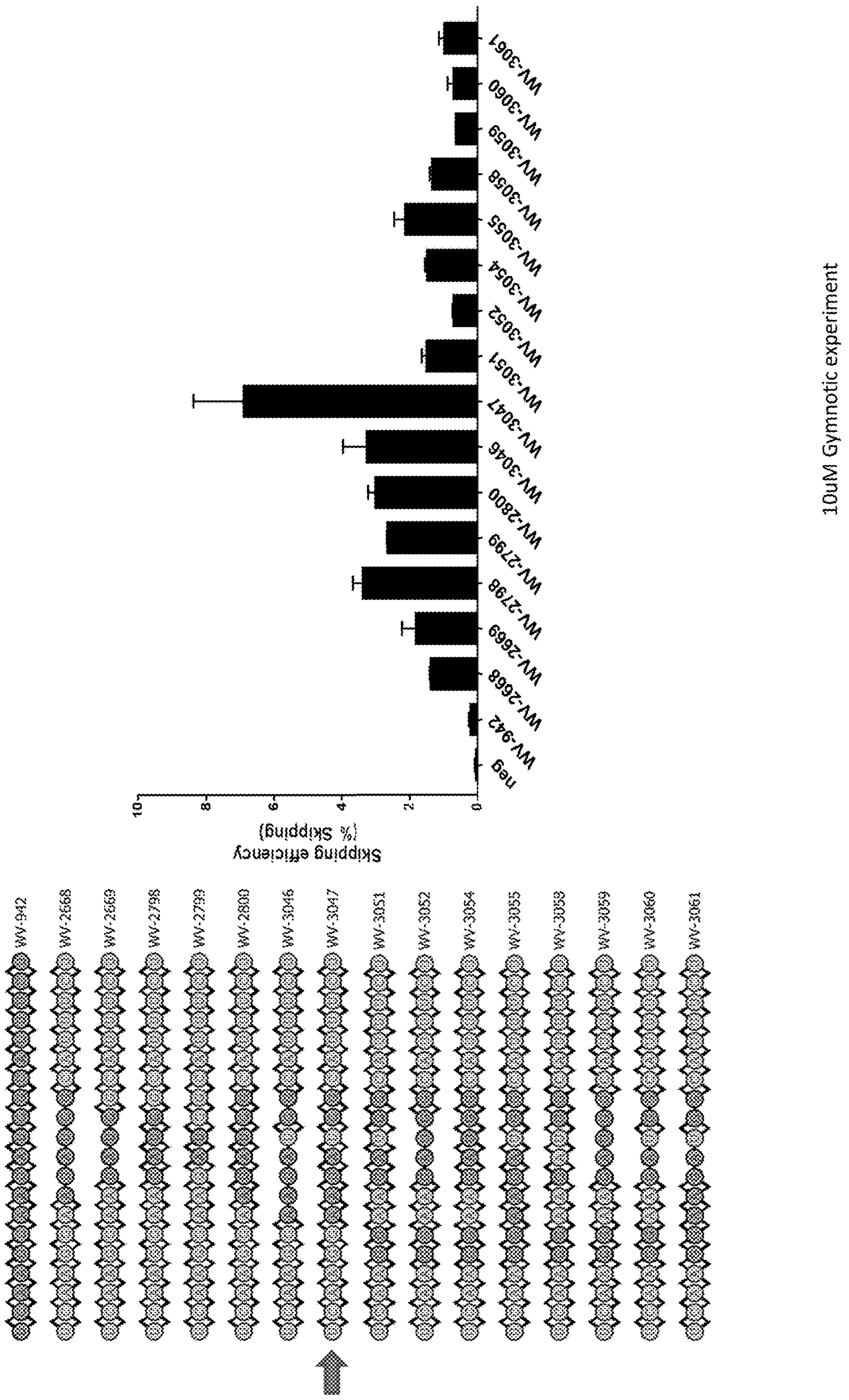

FIG. 36 shows example skipping efficiency of certain provided oligonucleotide compositions in skipping exon 51 of human dystrophin, compared to WV-942. Data for a dose of 10 μM are presented. Treatment was gymnotic (without transfection reagent). DMD del48-50 cells were used. WV-942 (SEQ ID NO: 261), WV-2668 (SEQ ID NO: 685), WV-2669 (SEQ ID NO: 686), WV-2798 (SEQ ID NO: 712), WV-2799 (SEQ ID NO: 713), WV-2800 (SEQ ID NO: 714), WV-3046 (SEQ ID NO: 754), WV-3047 (SEQ ID NO: 755), WV-3051 (SEQ ID NO: 759), WV-3052 (SEQ ID NO: 760), WV-3054 (SEQ ID NO: 762), WV-3055 (SEQ ID NO: 763), WV-3058 (SEQ ID NO: 766), WV-3059 (SEQ ID NO: 767), WV-3060 (SEQ ID NO: 768), and WV-3061 (SEQ ID NO: 769).

Figure 37:
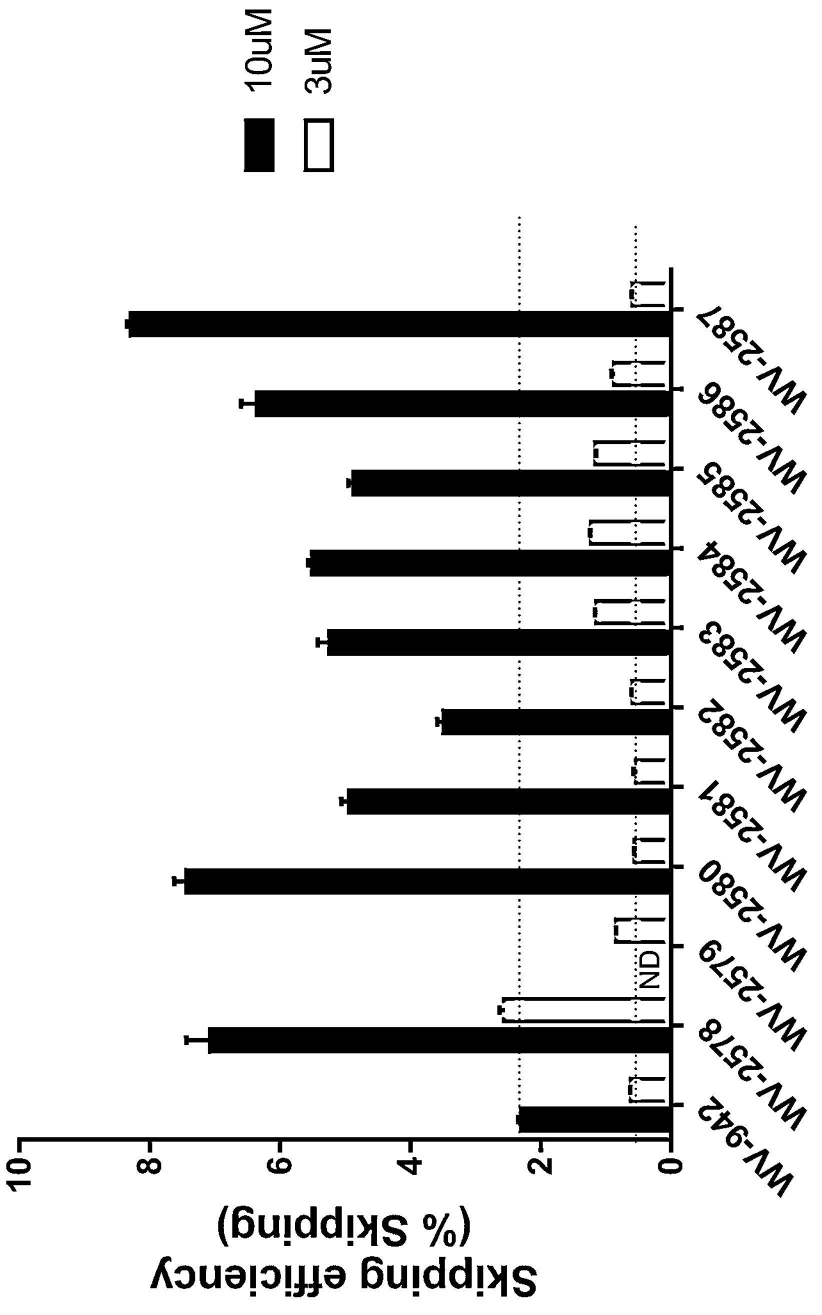

FIG. 37 shows example skipping efficiency of certain provided oligonucleotide compositions in skipping exon 51 of human dystrophin, compared to WV-942. Data for two doses, 3 μM (right column) and 10 μM (left column), are presented. Treatment was gymnotic (without transfection reagent). Under tested conditions, lipid conjugation increased skipping efficiency.

Figure 38A:
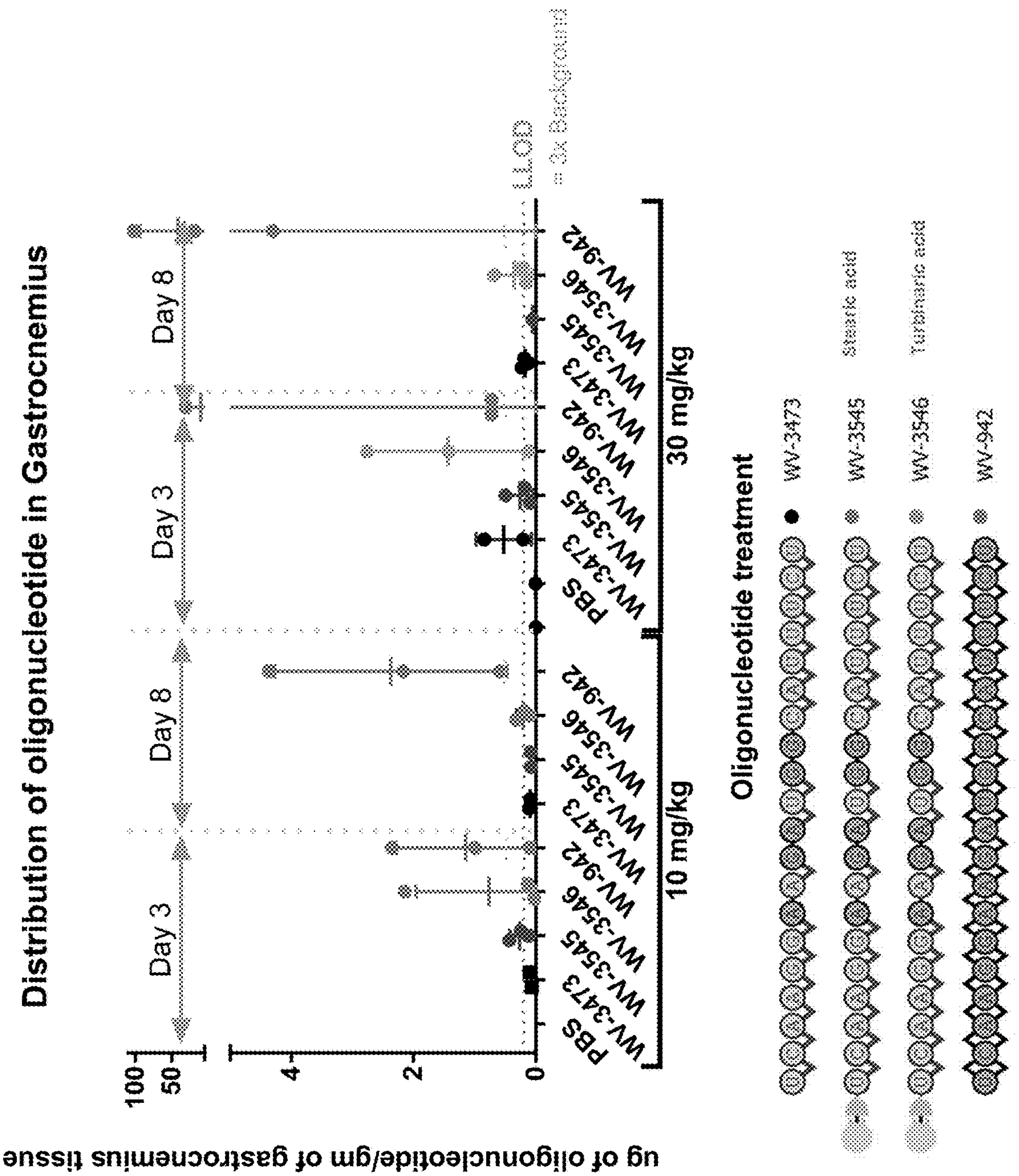
Figure 38B:
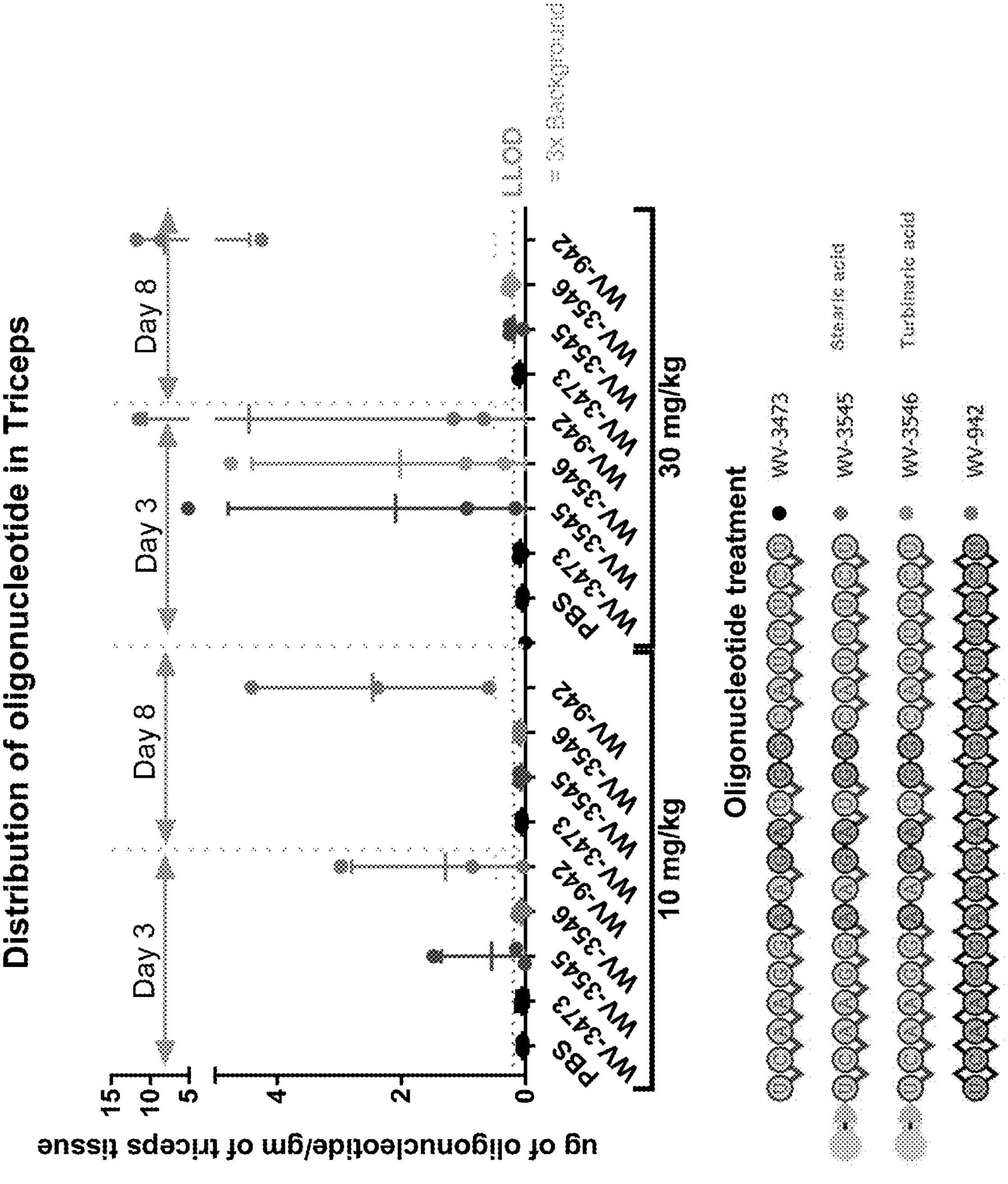
Figure 38C:
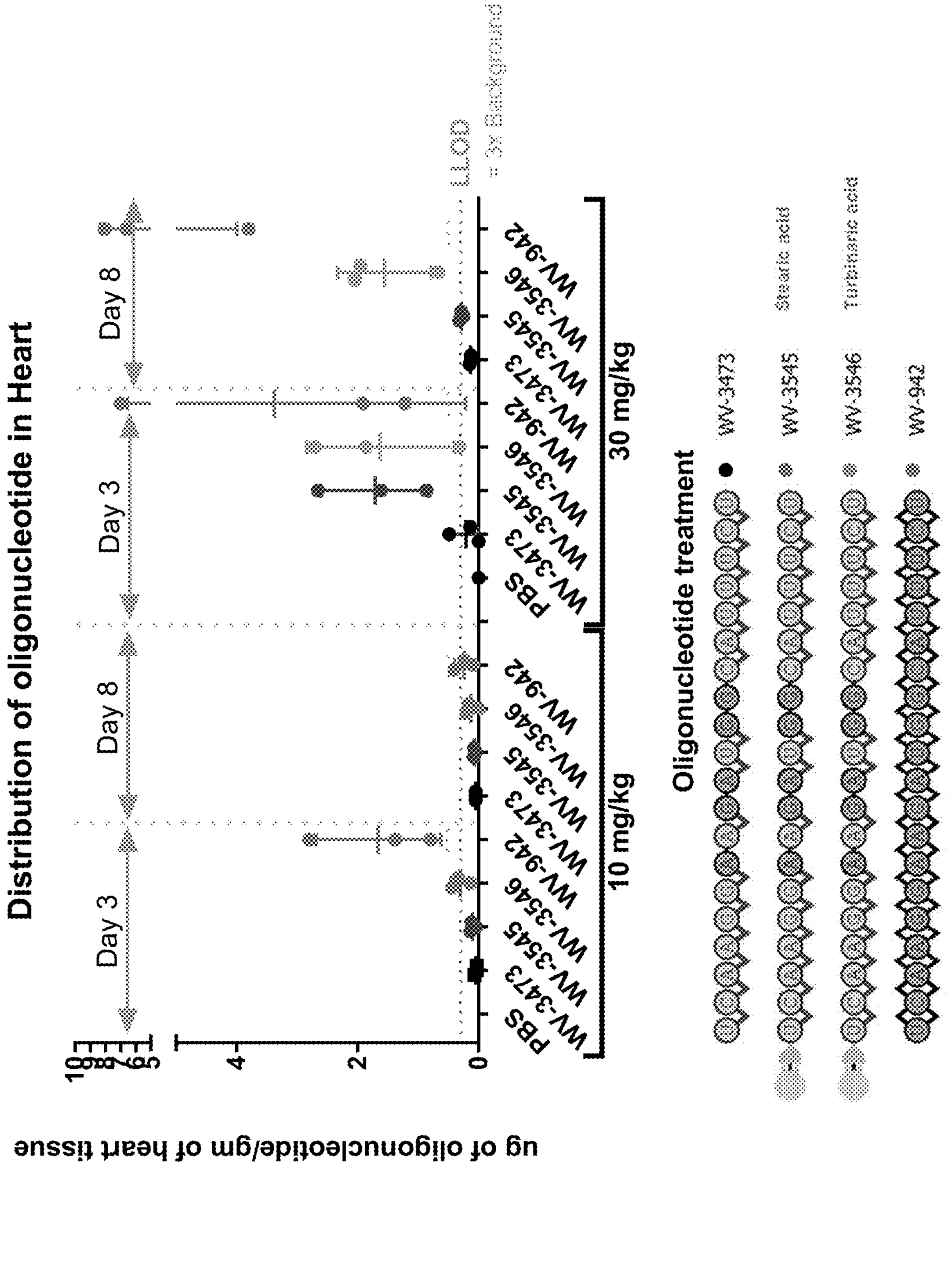
Figure 38D:
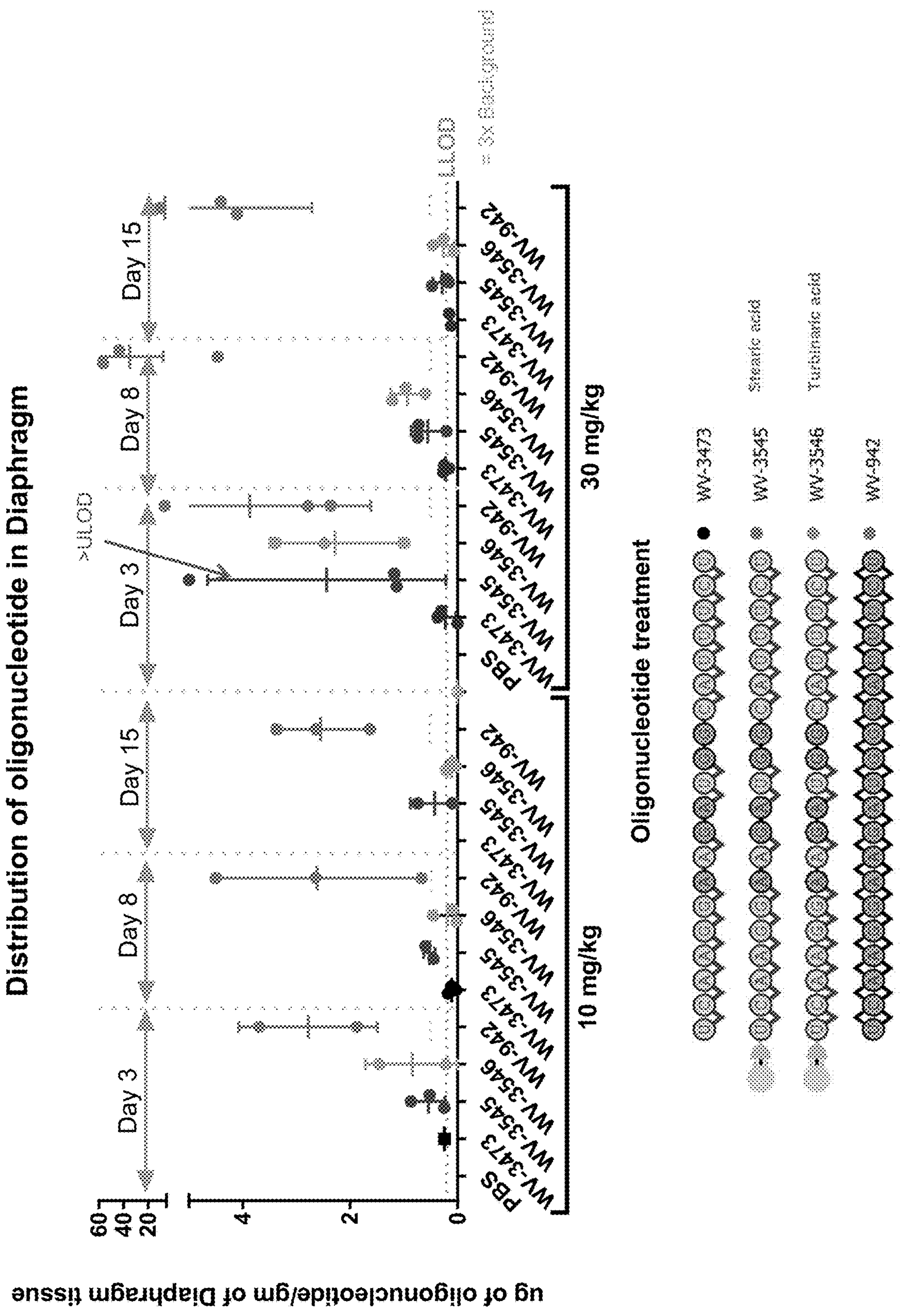

FIGS. 38A to 38D show example distribution of oligonucleotides in various muscle tissues: gastrocnemius (FIG. 38A); triceps (FIG. 38B); heart (FIG. 38C); and diaphragm (FIG. 38D). WV-3473 (SEQ ID NO: 820), WV-3545 (SEQ ID NO: 838), WV-3546 (SEQ ID NO: 839), and WV-942 (SEQ ID NO: 261).

DETAILED DESCRIPTION OF CERTAIN EMBODIMENTS

Synthetic oligonucleotides provide useful molecular tools in a wide variety of applications. For example, oligonucleotides are useful in therapeutic, diagnostic, research, and new nanomaterials applications. The use of naturally occurring nucleic acids (e.g., unmodified DNA or RNA) is limited, for example, by their susceptibility to endo- and exo-nucleases. As such, various synthetic counterparts have been developed to circumvent these shortcomings. These include synthetic oligonucleotides that contain chemical modification, e.g., base modifications, sugar modifications, backbone modifications, etc., which, among other things, render these molecules less susceptible to degradation and improve other properties of oligonucleotides. Chemical modifications may also lead to certain undesired effects, such as increased toxicities, etc. From a structural point of view, modifications to internucleotide phosphate linkages introduce chirality, and certain properties of oligonucleotides may be affected by the configurations of the phosphorus atoms that form the backbone of the oligonucleotides. For example, in vitro studies have shown that the properties of antisense nucleotides such as binding affinity, sequence specific binding to the complementary RNA, stability to nucleases are affected by, inter alia, chirality of the backbone (e.g., the configurations of the phosphorus atoms).

Among other things, the present disclosure encompasses the recognition that structural elements of oligonucleotides, such as base sequence, chemical modifications (e.g., modifications of sugar, base, and/or internucleotidic linkages, and patterns thereof), and/or stereochemistry (e.g., stereochemistry of backbone chiral centers (chiral internucleotidic linkages), and/or patterns thereof), can have significant impact on properties, e.g., activities, toxicities, e.g., as may be mediated by protein binding characteristics, stability, splicing-altering capabilities, etc. In some embodiments, oligonucleotide properties can be adjusted by optimizing chemical modifications (modifications of base, sugar, and/or internucleotidic linkage) and/or stereochemistry (pattern of backbone chiral centers).

In some embodiments, the present disclosure demonstrates that oligonucleotide compositions comprising oligonucleotides with controlled structural elements, e.g., controlled chemical modification and/or controlled backbone stereochemistry patterns, provide unexpected properties, including but not limited to those described herein. In some embodiments, provided compositions comprising oligonucleotides having chemical modifications (e.g., base modifications, sugar modification, internucleotidic linkage modifications, etc.) have improved properties, such as improved splicing-altering capabilities, lower toxicity, or improved protein binding profile, and/or improved delivery, etc. Particularly, in some embodiments, the present disclosure provides compositions and methods for altering splicing of transcripts. In some embodiments, the present disclosure provides compositions and methods for improving splicing of transcripts. In some embodiments, altered transcript splicing by provided compositions and methods include production of products having desired and/or improved biological functions, and/or knockdown of undesired product by, e.g., modifying splicing products so that undesired biological functions can be suppressed or removed.

In some embodiments, a transcript is pre-mRNA. In some embodiments, a splicing product is mature RNA. In some embodiments, a splicing product is mRNA. In some embodiments, alteration comprises skipping one or more exons. In some embodiments, splicing of a transcript is improved in that exon skipping increases levels of mRNA and proteins that have improved beneficial activities compared with absence of exon skipping. In some embodiments, an exon causing frameshift is skipped. In some embodiments, an exon comprising an undesired mutation is skipped. In some embodiments, an exon comprising a premature termination codon is skipped. An undesired mutation can be a mutation causing changes in protein sequences; it can also be a silent mutation. In some embodiments, an exon comprising an undesired SNP is skipped.

In some embodiments, splicing of a transcript is improved in that exon skipping lowers levels of mRNA and proteins that have undesired activities compared with absence of exon skipping. In some embodiments, a target is knocked down through exon skipping which, by skipping one or more exons, causes premature stop codon and/or frameshift mutations.

Reading frame correction is achieved by skipping one or two exons flanking a deletion, by skipping in-frame exons containing a nonsense mutation, or by skipping duplicated exons.

In some embodiments, the present disclosure provides compositions and methods for reducing certain undesired repeats, such as CAG repeat (see, e.g., Evers, et al., Targeting several CAG expansion diseases by a single antisense oligonucleotide, PLoS One. 2011; 6(9):e24308. doi: 10.1371/journal.pone.0024308; Mulders, et al., Triplet-repeat oligonucleotide-mediated reversal of RNA toxicity in myotonic dystrophy, Proc Natl Acad Sci USA. 2009 Aug. 18; 106(33):13915-20; etc.) by altering splicing, e.g., exon skipping. Example targets include but are not limited to HTT, ATXN3, DMPK, CNBP, AR, C9ORF72 (target for familial frontotemporal dementia and amyotrophic lateral sclerosis) and those listed below:

| Disease | Sequence | Location | Parent of origin of expansion | Repeat number (normal) | Repeat number (pre-mutation) | Repeat number (disease) | Somatic instability |
|---|---|---|---|---|---|---|---|
| | | | Diseases with coding TNRs | | | | |
| DRPLA | CAG | ATN1 (exon 5) | P | 6-35 | 35-48 | 49-88 | Yes |
| HD | CAG | HTT (exon 1) | P | 6-29 | 29-37 | 38-180 | Yes |
| OPMD | GCN | PABPN1 (exon 1) | P and M | 10 | 12-17 | >11 | None found in tissue tested (hypothalamus) Yes |
| SCA1 | CAG | ATXN1 (exon 8) | P | 6-39 | 40 | 41-83 | |
| SCA2 | CAG | ATXN2 (exon 1) | P | <31 | 31-32 | 32-200 | Unknown |
| SCA3 (Machado-Joseph disease) | CAG | ATXN3 (exon 8) | P | 12-40 | 41-85 | 52-86 | Unknown |
| SCA6 | CAG | CACNA1A (exon 47) | P | <18 | 19 | 20-33 | None found |
| SCA7 | CAG | ATXN7 (exon 3) | P | 4-17 | 28-33 | >36 to >460 | Yes |
| SCA17 | CAG | TBP (exon 3) | P > M | 25-42 | 43-48 | 45-66 | Yes |
| SMBA | CAG | AR (exon 1) | P | 13-31 | 32-39 | 40 | None found |
| | | | Diseases with non-coding TNRs | | | | |
| DM1 | CTG | DMPK (3' UTR) | M | 5-37 | 37-50 | <50 | Yes |
| DM2 | CCTG | CNBP (intron 1) | Uncertain | <30 | 31-74 | 75-11,000 | Yes |
| FRAX-E | GCC | AFF2 (5' UTR) | M | 4-39 | 40-200 | >200 | Unknown |
| FRDA | GAA | FXN (intron 1) | Recessive | 5-30 | 31-100 | 70-1,000 | Yes |
| FXS | CGG | FMR1 (5' UTR) | M | 6-50 | 55-200 | 200-4,000 | Yes |
| HDL2 | CTG | JPH3 (exon 2A) | M | 6-27 | 29-35 | 36-57 | Unknown |
| SCA8 | CTG | ATXN8OS (3' UTR) | M | 15-34 | 34-89 | 89-250 | Unknown |
| SCA10 | ATTCT | ATXN10 (intron 9) | M and P (smaller changes with M) | 10-29 | 29-400 | 400-4,500 | Yes |
| SCA12 | CAG | PPP2R2B (5' UTR) | M and P (more unstable with P) | 7-28 | 28-66 | 66-78 | None found |

AFF2, AF4/FMR2 family, member 2; AR, androgen receptor; ATN1, atrophin 1; ATXN, ataxin; ATXN8OS, ATXN8 opposite strand (non-protein coding); CACNA1A, calcium channel, voltage-dependent, P/Q type, alpha 1A subunit; CNBP, CCHC-type zinc finger nucleic acid binding protein; DM, myotonic dystrophy; DMPK, dystrophia myotonica-protein kinase; DRPLA, dentatorubral-pallidoluysian atrophy; FMR1, fragile X mental retardation 1; FRAX-E, mental retardation, X-linked, associated with FRAXE; FRDA, Friedreich's ataxia; FXN, frataxin; FXS, fragile X syndrome; FXTAS, fragile X-associated tremor/ataxia syndrome; HD, Huntington's disease; HDL2, Huntington's disease-like 2; HTT, huntingtin; JPH3, junctophilin 3; M, maternal; OPMD, oculopharyngeal muscular dystrophy; P, paternal; PABPN1, poly(A) binding protein nuclear 1; PPP2R2B, protein phosphatase 2, regulatory subunit B; SCA, spinocerebellar ataxia; SMBA, spinomuscular bulbar atrophy; TBP, TATA-box binding protein; TNR, trinucleotide repeat.

In some embodiments, provided oligonucleotides in provided compositions, e.g., oligonucleotides of a first plurality, comprise base modifications, sugar modifications, and/or internucleotidic linkage modifications. In some embodiments, provided oligonucleotides comprise base modifications and sugar modifications. In some embodiments, provided oligonucleotides comprise base modifications and internucleotidic linkage modifications. In some embodiments, provided oligonucleotides comprise sugar modifications and internucleotidic modifications. In some embodiments, provided compositions comprise base modifications, sugar modifications, and internucleotidic linkage modifications. Example chemical modifications, such as base modifications, sugar modifications, internucleotidic linkage modifications, etc. are widely known in the art including but not limited to those described in this disclosure. In some embodiments, a modified base is substituted A, T, C, G or U. In some embodiments, a sugar modification is 2'-modification. In some embodiments, a 2'-modification is 2-F modification. In some embodiments, a 2'-modification is 2'-$OR^1$. In some embodiments, a 2'-modification is 2'-$OR^1$, wherein $R^1$ is optionally substituted alkyl. In some embodiments, a 2'-modification is 2'-OMe. In some embodiments, a 2'-modification is 2'-MOE. In some embodiments, a modified sugar moiety is a bridged bicyclic or polycyclic ring. In some embodiments, a modified sugar moiety is a bridged bicyclic or polycyclic ring having 5-20 ring atoms wherein one or more ring atoms are optionally and independently heteroatoms. Example ring structures are widely known in the art, such as those found in BNA, LNA, etc. In some embodiments, provided oligonucleotides comprise both one or more modified internucleotidic linkages and one or more natural phosphate linkages. In some embodiments, oligonucleotides comprising both modified internucleotidic linkage and natural phosphate linkage and compositions thereof provide improved properties, e.g., activities and toxicities, etc. In some embodiments, a modified internucleotidic linkage is a chiral internucleotidic linkage. In some embodiments, a modified internucleotidic linkage is a phosphorothioate linkage. In some embodiments, a modified internucleotidic linkage is a substituted phosphorothioate linkage. Among other things, the present disclosure encompasses the recognition that stereorandom oligonucleotide preparations contain a plurality of distinct chemical entities that differ from one another, e.g., in the stereochemical structure of individual backbone chiral centers within the oligonucleotide chain. Without control of stereochemistry of backbone chiral centers, stereorandom oligonucleotide preparations provide uncontrolled compositions comprising undetermined levels of oligonucleotide stereoisomers. Even though these stereoisomers may have the same base sequence, they are different chemical entities at least due to their different backbone stereochemistry, and they can have, as demonstrated herein, different properties, e.g., activities, toxicities, etc. Among other things, the present disclosure provides new compositions that are or contain particular stereoisomers of oligonucleotides of interest. In some embodiments, a particular stereoisomer may be defined, for example, by its base sequence, its length, its pattern of backbone linkages, and its pattern of backbone chiral centers. As is understood in the art, in some embodiments, base sequence may refer to the identity and/or modification status of nucleoside residues (e.g., of sugar and/or base components, relative to standard naturally occurring nucleotides such as adenine, cytosine, guanosine, thymine, and uracil) in an oligonucleotide and/or to the hybridization character (i.e., the ability to hybridize with particular complementary residues) of such residues. In some embodiments, oligonucleotides in provided compositions comprise sugar modifications, e.g., 2'-modifications, at e.g., a wing region. In some embodiments, oligonucleotides in provided compositions comprise a region in the middle, e.g., a core region, that has no sugar modifications. In some embodiments, the present disclosure provide an oligonucleotide composition comprising a predetermined level of oligonucleotides of an individual oligonucleotide type which are chemically identical, e.g., they have the same base sequence, the same pattern of nucleoside modifications (modifications to sugar and base moieties, if any), the same pattern of backbone chiral centers, and the same pattern of backbone phosphorus modifications. The present disclosure demonstrates, among other things, that individual stereoisomers of a particular oligonucleotide can show different stability and/or activity (e.g., functional and/or toxicity properties) from each other. In some embodiments, property improvements achieved through inclusion and/or location of particular chiral structures within an oligonucleotide can be comparable to, or even better than those achieved through use of particular backbone linkages, residue modifications, etc. (e.g., through use of certain types of modified phosphates [e.g., phosphorothioate, substituted phosphorothioate, etc.], sugar modifications [e.g., 2'-modifications, etc.], and/or base modifications [e.g., methylation, etc.]). Among other things, the present disclosure recognizes that, in some embodiments, properties (e.g., activities, toxicities, etc.) of an oligonucleotide can be adjusted by optimizing its pattern of backbone chiral centers, optionally in combination with adjustment/optimization of one or more other features (e.g., linkage pattern, nucleoside modification pattern, etc.) of the oligonucleotide. As exemplified by various examples in the present disclosure, provided chirally controlled oligonucleotide compositions can demonstrate improved properties, such as lower toxicity, improved protein binding profile, improved delivery, etc.

In some embodiments, provided oligonucleotides contain increased levels of one or more isotopes. In some embodiments, provided oligonucleotides are labeled, e.g., by one or more isotopes of one or more elements, e.g., hydrogen, carbon, nitrogen, etc. In some embodiments, provided oligonucleotides in provided compositions, e.g., oligonucleotides of a first plurality, comprise base modifications, sugar modifications, and/or internucleotidic linkage modifications, wherein the oligonucleotides contain an enriched level of deuterium. In some embodiments, provided oligonucleotides are labeled with deuterium (replacing $-^{1}H$ with $-^{2}H$) at one or more positions. In some embodiments, one or more $^{1}H$ of an oligonucleotide or any moiety conjugated to the oligonucleotide (e.g., a targeting moiety, lipid, etc.) is substituted with $^{2}H$. Such oligonucleotides can be used in any composition or method described herein.

In some embodiments, oligonucleotide properties can be adjusted by optimizing stereochemistry (pattern of backbone chiral centers) and chemical modifications (modifications of base, sugar, and/or internucleotidic linkage). Among other things, the present disclosure demonstrates that stereochemistry can further improve properties of oligonucleotides comprising chemical modifications. In some embodiments, the present disclosure provides oligonucleotide compositions wherein the oligonucleotides comprise nucleoside modifications, chiral internucleotidic linkages and natural phosphate linkages. For example, WV-1092 (mG*SmGmCmAmC*SA*SA*SG*SG*SG*SC*SA*SC*RA*SG*SmAmCmUmU*SmC (SEQ ID NO: 6)) comprises 2'-OMe modifications, phosphate and phosphorothioate linkages in its 5'- and 3'-wing regions, and phosphorothioate linkages in its core regions.

In some embodiments, the present disclosure provides oligonucleotide compositions which, unexpectedly, greatly improve properties of oligonucleotides. In some embodiments, provided oligonucleotide compositions provides surprisingly low toxicity. In some embodiments, provided oligonucleotide compositions provides surprisingly improved protein binding profile. In some embodiments, provided oligonucleotide compositions provides surprisingly enhanced delivery. In some embodiments, certain property improvement, such as lower toxicity, improved protein binding profile, and/or enhanced delivery, etc., are achieved without sacrificing other properties, e.g., activities, specificity, etc. In some embodiments, provided compositions provides lower toxicity, improved protein binding profile, and/or enhanced delivery, and improved activity, stability, and/or specificity (e.g., target-specificity, cleavage site specificity, etc.). Example improved activities (e.g., enhanced cleavage rates, increased target-specificity, cleavage site specificity, etc.) include but are not limited to those described in WO/2014/012081 and WO/2015/107425.

In some embodiments, a pattern of backbone chiral centers provides increased stability. In some embodiments, a pattern of backbone chiral centers provides surprisingly increased activity. In some embodiments, a pattern of backbone chiral centers provides increased stability and activity. In some embodiments, a pattern of backbone chiral centers provides surprisingly low toxicity. In some embodiments, a pattern of backbone chiral centers provides surprisingly low immune response. In some embodiments, a pattern of backbone chiral centers provides surprisingly low complement activation. In some embodiments, a pattern of backbone chiral centers provides surprisingly low complement activation via the alternative pathway. In some embodiments, a pattern of backbone chiral centers provides surprisingly improved protein binding profile. In some embodiments, a pattern of backbone chiral centers provides surprisingly increased binding to certain proteins. In some embodiments, a pattern of backbone chiral centers provides surprisingly enhanced delivery. In some embodiments, a pattern of backbone chiral centers comprises or is (Sp)m(Rp)n, (Rp)n (Sp)m, (Np)t(Rp)n(Sp)m, or (Sp)t(Rp)n(Sp)m. In some embodiments, a pattern of backbone chiral centers comprises or is (Rp)n(Sp)m, (Np)t(Rp)n(Sp)m, or (Sp)t(Rp)n (Sp)m, wherein m>2. In some embodiments, a pattern of backbone chiral centers comprises or is (Rp)n(Sp)m, (Np)t (Rp)n(Sp)m, or (Sp)t(Rp)n(Sp)m, wherein n is 1, t>1, and m>2. In some embodiments, m>3. In some embodiments, m>4. In some embodiments, a pattern of backbone chiral centers comprises one or more achiral natural phosphate linkages.

In some embodiments, the present disclosure recognizes that chemical modifications, such as modifications of nucleosides and internucleotidic linkages, can provide enhanced properties. In some embodiments, the present disclosure demonstrates that combinations of chemical modifications and stereochemistry can provide unexpected, greatly improved properties (e.g., bioactivity, selectivity, etc.). In some embodiments, chemical combinations, such as modifications of sugars, bases, and/or internucleotidic linkages, are combined with stereochemistry patterns, e.g., (Rp) n(Sp)m, (Np)t(Rp)n(Sp)m, or (Sp)t(Rp)n(Sp)m, to provide oligonucleotides and compositions thereof with surprisingly enhanced properties. In some embodiments, a provided oligonucleotide composition is chirally controlled, and comprises a combination of 2'-modification of one or more sugar moieties, one or more natural phosphate linkages, one or more phosphorothioate linkages, and a stereochemistry pattern of (Rp)n(Sp)m, (Np)t(Rp)n(Sp)m, or (Sp)t(Rp)n(Sp)m, wherein m>2. In some embodiments, n is 1, t>1, and m>2. In some embodiments, m>3. In some embodiments, m>4.

In some embodiments, a pattern of backbone chiral centers comprises or is (Rp)n(Sp)m, (Sp)t(Rp)n, (Np)t(Rp)n (Sp)m, (Sp)t(Sp)m or (Sp)t(Rp)n(Sp)m. In some embodiments, a pattern of backbone chiral centers comprises or is (Rp)n(Sp)m, (Sp)t(Rp)n, (Np)t(Rp)n(Sp)m, or (Sp)t(Rp)n (Sp)m, and the oligonucleotides comprises one or more 2'-modifications as described herein. In some embodiments, a pattern of backbone chiral centers comprises or is (Rp)n (Sp)m, (Sp)t(Rp)n, (Np)t(Rp)n(Sp)m, or (Sp)t(Rp)n(Sp)m, and the oligonucleotides comprises one or more 2'-F modifications as described herein. In some embodiments, a pattern of backbone chiral centers comprises or is (Rp)n(Sp) m, (Sp)t(Rp)n, (Np)t(Rp)n(Sp)m, or (Sp)t(Rp)n(Sp)m, and the oligonucleotides comprises one or more 2'-OR modifications as described herein. In some embodiments, a pattern of backbone chiral centers comprises or is (Rp)n(Sp)m. In some embodiments, a pattern of backbone chiral centers comprises or is (Sp)t(Rp)n. In some embodiments, a pattern of backbone chiral centers comprises or is (Np)t(Rp)n(Sp)m. In some embodiments, a pattern of backbone chiral centers comprises or is (Sp)t(Sp)m, optionally with n achiral phosphate diester internucleotidic linkages and/or stereorandom (non-chirally controlled) chiral internucleotidic linkages between the section having (Sp)t and the section having (Sp)m. In some embodiments, there are n achiral phosphate diester internucleotidic linkages in between. In some embodiments, there are n stereorandom chiral internucleotidic linkages in between. In some embodiments, a pattern of backbone chiral centers comprises or is (Sp)t(Rp)n(Sp)m. In some embodiments, each of t and m is independently greater than 1, 2, 3, 4, 5, 6, 7, 8, 9, 10, 11, 12, 13, 14, 15, 16, 17, 18, 19 or 20. In some embodiments, each of t and m is independently greater than 1. In some embodiments, each of t and m is independently greater than 2. In some embodiments, each of t and m is independently greater than 2. In some embodiments, each of t and m is independently greater than 3. In some embodiments, each of t and m is independently greater than 4. In some embodiments, each of t and m is independently greater than 5. In some embodiments, each of t and m is independently greater than 6. In some embodiments, each of t and m is independently greater than 7. In some embodiments, each of t and m is independently greater than 8. In some embodiments, each of t and m is independently greater than 9. In some embodiments, each of t and m is independently greater than 10. In some embodiments, each of t and m is independently greater than 11. In some embodiments, each of t and m is independently greater than 12. In some embodiments, each of t and m is independently greater than 13. In some embodiments, each of t and m is independently greater than 14. In some embodiments, each of t and m is independently greater than 15. In some embodiments, t is greater than 1, 2, 3, 4, 5, 6, 7, 8, 9, 10, 11, 12, 13, 14, 15, 16, 17, 18, 19 or 20. In some embodiments, t is greater than 1. In some embodiments, t is greater than 2. In some embodiments, t is greater than 2. In some embodiments, t is greater than 3. In some embodiments, t is greater than 4. In some embodiments, t is greater than 5. In some embodiments, t is greater than 6. In some embodiments, t is greater than 7. In some embodiments, t is greater than 8. In some embodiments, t is greater than 9. In some embodiments, t is greater than 10. In some embodiments, t is greater than 11. In some embodiments, t is greater than 12. In some embodiments, t is greater than 13. In some embodiments, t is greater than 14. In some embodiments, t is greater than 15. In some embodiments, t is 1, 2, 3, 4, 5, 6, 7, 8, 9, 10, 11, 12, 13, 14, 15, 16, 17, 18, 19 or 20. In some embodiments, t is 1. In some embodiments, t is 2. In some embodiments, t is 2. In some embodiments, t is 3. In some embodiments, t is 4. In some embodiments, t is 5. In some embodiments, t is 6. In some embodiments, t is 7. In some embodiments, t is 8. In some embodiments, t is 9. In some embodiments, t is 10. In some embodiments, t is 11. In some embodiments, t is 12. In some embodiments, t is 13. In some embodiments, t is 14. In some embodiments, t is 15. In some embodiments, m is greater than 1, 2, 3, 4, 5, 6, 7, 8, 9, 10, 11, 12, 13, 14, 15, 16, 17, 18, 19 or 20. In some embodiments, m is greater than 1. In some embodiments, m is greater than 2. In some embodiments, m is greater than 2. In some embodiments, m is greater than 3. In some embodiments, m is greater than 4. In some embodiments, m is greater than 5. In some embodiments, m is greater than 6. In some embodiments, m is greater than 7. In some embodiments, m is greater than 8. In some embodiments, m is greater than 9. In some embodiments, m is greater than 10. In some embodiments, m is greater than 11. In some embodiments, m is greater than 12. In some embodiments, m is greater than 13. In some embodiments, m is greater than 14. In some embodiments, m is greater than 15. In some embodiments, m is 1, 2, 3, 4, 5, 6, 7, 8, 9, 10, 11, 12, 13, 14, 15, 16, 17, 18, 19 or 20. In some embodiments, m is 1. In some embodiments, m is 2. In some embodiments, m is 2. In some embodiments, m is 3. In some embodiments, m is 4. In some embodiments, m is 5. In some embodiments, m is 6. In some embodiments, m is 7. In some embodiments, m is 8. In some embodiments, m is 9. In some embodiments, m is 10. In some embodiments, m is 11. In some embodiments, m is 12. In some embodiments, m is 13. In some embodiments, m is 14. In some embodiments, m is 15. In some embodiments, t=m. In some embodiments, n is greater than 1, 2, 3, 4, 5, 6, 7, 8, 9, 10, 11, 12, 13, 14, 15, 16, 17, 18, 19 or 20. In some embodiments, n is greater than 1. In some embodiments, n is greater than 2. In some embodiments, n is greater than 2. In some embodiments, n is greater than 3. In some embodiments, n is greater than 4. In some embodiments, n is greater than 5. In some embodiments, n is greater than 6. In some embodiments, n is greater than 7. In some embodiments, n is greater than 8. In some embodiments, n is greater than 9. In some embodiments, n is greater than 10. In some embodiments, n is greater than 11. In some embodiments, n is greater than 12. In some embodiments, n is greater than 13. In some embodiments, n is greater than 14. In some embodiments, n is greater than 15. In some embodiments, n is 1, 2, 3, 4, 5, 6, 7, 8, 9, 10, 11, 12, 13, 14, 15, 16, 17, 18, 19 or 20. In some embodiments, n is 1. In some embodiments, n is 2. In some embodiments, n is 2. In some embodiments, n is 3. In some embodiments, n is 4. In some embodiments, n is 5. In some embodiments, n is 6. In some embodiments, n is 7. In some embodiments, n is 8. In some embodiments, n is 9. In some embodiments, n is 10. In some embodiments, n is 11. In some embodiments, n is 12. In some embodiments, n is 13. In some embodiments, n is 14. In some embodiments, n is 15.

In some embodiments, a common pattern of backbone chiral centers is comprises SSS, SSSS, SSSSS, SSSSSS, SSSSSSS, SOS, SSOSS, SSSOSSS, SSSSOSSSS, SSSSSOSSSSS, SSSSSSOSSSSSS, SSSSSSSOSSSSSSS, SSSSSSSSOSSSSSSSS, SSSSSSSSSOSSSSSSSSS, SOSOSOSOS, SSOSOSOSOSS, SSSOSOSOSOSSS, SSSSOSOSOSOSSSS, SSSSSOSOSOSOSSSSS, SSSSSSOSOSOSOSSSSSS, SOSOSSOOS, SSOSOSSOOSS, SSSOSOSSOOSSS, SSSSOSOSSOOSSSS, SSSSSOSOSSOOSSSSS, SSSSSSOSOSSOOSSSSSS, SOSOOSOOS, SSOSOOSOOSS, SSSOSOOSOOSSS, SSSSOSOOSOOSSSS, SSSSSOSOOSOOSSSSS, SSSSSSOSOOSOOSSSSSS, SOSOSSOOS, SSOSOSSOOSO, SSSOSOSSOOSOS, SSSSOSOSSOOSOSS, SSSSSOSOSSOOSOSSS, SSSSSSOSOSSOOSOSSSS, SOSOOSOOSO, SSOSOOSOOSOS, SSSOSOOSOOSOS, SSSSOSOOSOOSOSS, SSSSSOSOOSOOSOSSS, SSSSSSOSOOSOOSOSSSS, SSOSOSSOO, SSSOSOSSOOS, SSSSOSOSSOOS, SSSSSOSOSSOOSS, SSSSSSOSOSSOOSSS, OSSSSSSOSOSSOOSSS, OOSSSSSSOSOSSOOS, OOSSSSSSOSOSSOOSS, OOSSSSSSOSOSSOOSSS, OOSSSSSSOSOSSOOSSSS, OOSSSSSSOSOSSOOSSSSS, and/or OOSSSSSSOSOSSOOSSSSSS, wherein O is a non-chiral internucleotidic linkage and S is an Sp chiral internucleotidic linkage. In some embodiments, the non-chiral center is a phosphodiester linkage. In some embodiments, the chiral center in a Sp configuration is a phosphorothioate linkage. In some embodiments, a common pattern of backbone chiral centers is selected from: SSS, SSSS, SSSSS, SSSSSS, SSSSSSS, SOS, SSOSS, SSSOSSS, SSSSOSSSS, SSSSSOSSSSS, SSSSSSOSSSSSS, SSSSSSSOSSSSSSS, SSSSSSSSOSSSSSSSS, SSSSSSSSSOSSSSSSSSS, SOSOSOSOS, SSOSOSOSOSS, SSSOSOSOSOSSS, SSSSOSOSOSOSSSS, SSSSSOSOSOSOSSSSS, SSSSSSOSOSOSOSSSSSS, SOSOSSOOS, SSOSOSSOOSS, SSSOSOSSOOSSS, SSSSOSOSSOOSSSS, SSSSSOSOSSOOSSSSS, SSSSSSOSOSSOOSSSSSS, SOSOOSOOS, SSOSOOSOOSS, SSSOSOOSOOSSS, SSSSOSOOSOOSSSS, SSSSSOSOOSOOSSSSS, SSSSSSOSOOSOOSSSSSS, SOSOSSOOS, SSOSOSSOOSO, SSSOSOSSOOSOS, SSSSOSOSSOOSOSS, SSSSSOSOSSOOSOSSS, SSSSSSOSOSSOOSOSSSS, SOSOOSOOSO, SSOSOOSOOSOS, SSSOSOOSOOSOS, SSSSOSOOSOOSOSS, SSSSSOSOOSOOSOSSS, SSSSSSOSOOSOOSOSSSS, SSOSOSSOO, SSSOSOSSOOS, SSSSOSOSSOOS, SSSSSOSOSSOOSS, SSSSSSOSOSSOOSSS, OSSSSSSOSOSSOOSSS, OOSSSSSSOSOSSOOS, OOSSSSSSOSOSSOOSS, OOSSSSSSOSOSSOOSSS, OOSSSSSSOSOSSOOSSSS, OOSSSSSSOSOSSOOSSSSS, and OOSSSSSSOSOSSOOSSSSSS, wherein O is a non-chiral internucleotidic linkage and S is an Sp chiral internucleotidic linkage. In some embodiments, the non-chiral center is a phosphodiester linkage. In some embodiments, the chiral center in a Sp configuration is a phosphorothioate linkage.

In some embodiments, the 5'-end region of provided oligonucleotides, e.g., a 5'-wing, comprises a stereochemistry pattern of S, SS, SSS, SSSS, SSSSS, SSSSSS, or SSSSSS. In some embodiments, the 5'-end region comprises a stereochemistry pattern of SSS. In some embodiments, the 5'-end region comprises a stereochemistry pattern of SSSS. In some embodiments, the 5'-end region comprises a stereochemistry pattern of SSSSS. In some embodiments, the 5'-end region comprises a stereochemistry pattern of SSSSSS. In some embodiments, the 5'-end region comprises a stereochemistry pattern of SSSSSSS. In some embodiments, each S is represents an Sp phosphorothioate internucleotidic linkage. In some embodiments, the 5'-end region of provided oligonucleotides, e.g., a 5'-wing, comprises a stereochemistry pattern of S, SS, SSS, SSSS, SSSSS, SSSSSS, or SSSSSS, wherein the first S represents the first (the 5'-end) internucleotidic linkage of a provided oligonucleotide. In some embodiments, the 5'-end region comprises a stereochemistry pattern of SSS, wherein the first S represents the first internucleotidic linkage. In some embodiments, the 5'-end region comprises a stereochemistry pattern of SSSS, wherein the first S represents the first internucleotidic linkage. In some embodiments, the 5'-end region comprises a stereochemistry pattern of SSSSS, wherein the first S represents the first internucleotidic linkage. In some embodiments, the 5'-end region comprises a stereochemistry pattern of SSSSSS, wherein the first S represents the first internucleotidic linkage. In some embodiments, the 5'-end region comprises a stereochemistry pattern of SSSSSSS, wherein the first S represents the first internucleotidic linkage. In some embodiments, each S represents an Sp phosphorothioate internucleotidic linkage. In some embodiments, one or more nucleotidic units comprising an Sp internucleotidic linkage in the 5'-end region independently comprise —F. In some embodiments, each nucleotidic unit comprising an Sp internucleotidic linkage in the 5'-end region independently comprises —F. In some embodiments, one or more nucleotidic units comprising an Sp internucleotidic linkage in the 5'-end region independently comprise a sugar modification. In some embodiments, each nucleotidic unit comprising an Sp internucleotidic linkage in the 5'-end region independently comprises a sugar modification. In some embodiments, each 2'-modification is the same. In some embodiments, a sugar modification is a 2'-modification. In some embodiments, a 2'-modification is 2'-$OR^1$. In some embodiments, a 2'-modification is 2'-F. In some embodiments, the 3'-end region of provided oligonucleotides, e.g., a 3'-wing, comprises a stereochemistry pattern of S, SS, SSS, SSSS, SSSSS, SSSSSS, or SSSSSS. In some embodiments, the 3'-end region comprises a stereochemistry pattern of SSS. In some embodiments, the 3'-end region comprises a stereochemistry pattern of SSSS. In some embodiments, the 3'-end region comprises a stereochemistry pattern of SSSSS. In some embodiments, the 3'-end region comprises a stereochemistry pattern of SSSSSS. In some embodiments, the 3'-end region comprises a stereochemistry pattern of SSSSSSS. In some embodiments, each S is represents an Sp phosphorothioate internucleotidic linkage. In some embodiments, the 3'-end region of provided oligonucleotides, e.g., a 3'-wing, comprises a stereochemistry pattern of S, SS, SSS, SSSS, SSSSS, SSSSSS, or SSSSSS, wherein the last S represents the last (the 3'-end) internucleotidic linkage of a provided oligonucleotide. In some embodiments, the 3'-end region comprises a stereochemistry pattern of SSS, wherein the last S represents the last internucleotidic linkage. In some embodiments, the 3'-end region comprises a stereochemistry pattern of SSSS, wherein the last S represents the last internucleotidic linkage. In some embodiments, the 3'-end region comprises a stereochemistry pattern of SSSSS, wherein the last S represents the last internucleotidic linkage. In some embodiments, the 3'-end region comprises a stereochemistry pattern of SSSSSS, wherein the last S represents the last internucleotidic linkage. In some embodiments, the 3'-end region comprises a stereochemistry pattern of SSSSSSS, wherein the last S represents the last internucleotidic linkage. In some embodiments, each S represents an Sp phosphorothioate internucleotidic linkage. In some embodiments, one or more nucleotidic units comprising an Sp internucleotidic linkage in the 3'-end region independently comprise —F. In some embodiments, each nucleotidic unit comprising an Sp internucleotidic linkage in the 3'-end region independently comprises —F. In some embodiments, one or more nucleotidic units comprising an Sp internucleotidic linkage in the 3'-end region independently comprise a sugar modification. In some embodiments, each nucleotidic unit comprising an Sp internucleotidic linkage in the 3'-end region independently comprises a sugar modification. In some embodiments, each 2'-modification is the same. In some embodiments, a sugar modification is a 2'-modification. In some embodiments, a 2'-modification is $2'\text{-OR}^1$. In some embodiments, a 2'-modification is 2'-F. In some embodiments, provided oligonucleotides comprise both a 5'-end region, e.g., a 5'-wing, and a 3'-end region, e.g., a 3'-end wing, as described herein. In some embodiments, the 5'-end region comprises a stereochemistry pattern of SS, wherein the first S represents the first internucleotidic linkage of a provide oligonucleotide, a the 3'-end region comprises a stereochemistry pattern of SS, wherein one or more nucleotidic unit comprising an Sp internucleotidic linkage in the 5'- or 3'-end region comprise —F. In some embodiments, the 5'-end region comprises a stereochemistry pattern of SS, wherein the first S represents the first internucleotidic linkage of a provide oligonucleotide, a the 3'-end region comprises a stereochemistry pattern of SS, wherein one or more nucleotidic unit comprising an Sp internucleotidic linkage in the 5'- or 3'-end region comprise a 2'-F sugar modification. In some embodiments, the 5'-end region comprises a stereochemistry pattern of SS, wherein the first S represents the first internucleotidic linkage of a provide oligonucleotide, a the 3'-end region comprises a stereochemistry pattern of SS, wherein each nucleotidic unit comprising an Sp internucleotidic linkage in the 5'- or 3'-end region comprises —F. In some embodiments, the 5'-end region comprises a stereochemistry pattern of SS, wherein the first S represents the first internucleotidic linkage of a provide oligonucleotide, a the 3'-end region comprises a stereochemistry pattern of SS, wherein each nucleotidic unit comprising an Sp internucleotidic linkage in the 5'- or 3'-end region comprises a 2'-F sugar modification. In some embodiments, the 5'-end region comprises a stereochemistry pattern of SSS, wherein the first S represents the first internucleotidic linkage of a provide oligonucleotide, a the 3'-end region comprises a stereochemistry pattern of SSS, wherein one or more nucleotidic unit comprising an Sp internucleotidic linkage in the 5'- or 3'-end region comprise —F. In some embodiments, the 5'-end region comprises a stereochemistry pattern of SSS, wherein the first S represents the first internucleotidic linkage of a provide oligonucleotide, a the 3'-end region comprises a stereochemistry pattern of SSS, wherein one or more nucleotidic unit comprising an Sp internucleotidic linkage in the 5'- or 3'-end region comprise a 2'-F sugar modification. In some embodiments, the 5'-end region comprises a stereochemistry pattern of SSS, wherein the first S represents the first internucleotidic linkage of a provide oligonucleotide, a the 3'-end region comprises a stereochemistry pattern of SSS, wherein each nucleotidic unit comprising an Sp internucleotidic linkage in the 5'- or 3'-end region comprises —F. In some embodiments, the 5'-end region comprises a stereochemistry pattern of SSS, wherein the first S represents the first internucleotidic linkage of a provide oligonucleotide, a the 3'-end region comprises a stereochemistry pattern of SSS, wherein each nucleotidic unit comprising an Sp internucleotidic linkage in the 5'- or 3'-end region comprises a 2'-F sugar modification. In some embodiments, the 5'-end region comprises a stereochemistry pattern of SSSS, wherein the first S represents the first internucleotidic linkage of a provide oligonucleotide, a the 3'-end region comprises a stereochemistry pattern of SSSS, wherein one or more nucleotidic unit comprising an Sp internucleotidic linkage in the 5'- or 3'-end region comprise —F. In some embodiments, the 5'-end region comprises a stereochemistry pattern of SSSS, wherein the first S represents the first internucleotidic linkage of a provide oligonucleotide, a the 3'-end region comprises a stereochemistry pattern of SSSS, wherein one or more nucleotidic unit comprising an Sp internucleotidic linkage in the 5'- or 3'-end region comprise a 2'-F sugar modification. In some embodiments, the 5'-end region comprises a stereochemistry pattern of SSSS, wherein the first S represents the first internucleotidic linkage of a provide oligonucleotide, a the 3'-end region comprises a stereochemistry pattern of SSSS, wherein each nucleotidic unit comprising an Sp internucleotidic linkage in the 5'- or 3'-end region comprises —F. In some embodiments, the 5'-end region comprises a stereochemistry pattern of SSSS, wherein the first S represents the first internucleotidic linkage of a provide oligonucleotide, a the 3'-end region comprises a stereochemistry pattern of SSSS, wherein each nucleotidic unit comprising an Sp internucleotidic linkage in the 5'- or 3'-end region comprises a 2'-F sugar modification. In some embodiments, the 5'-end region comprises a stereochemistry pattern of SSSSS, wherein the first S represents the first internucleotidic linkage of a provide oligonucleotide, a the 3'-end region comprises a stereochemistry pattern of SSSSS, wherein one or more nucleotidic unit comprising an Sp internucleotidic linkage in the 5'- or 3'-end region comprise —F. In some embodiments, the 5'-end region comprises a stereochemistry pattern of SSSSS, wherein the first S represents the first internucleotidic linkage of a provide oligonucleotide, a the 3'-end region comprises a stereochemistry pattern of SSSSS, wherein one or more nucleotidic unit comprising an Sp internucleotidic linkage in the 5'- or 3'-end region comprise a 2'-F sugar modification. In some embodiments, the 5'-end region comprises a stereochemistry pattern of SSSSS, wherein the first S represents the first internucleotidic linkage of a provide oligonucleotide, a the 3'-end region comprises a stereochemistry pattern of SSSSS, wherein each nucleotidic unit comprising an Sp internucleotidic linkage in the 5'- or 3'-end region comprises —F. In some embodiments, the 5'-end region comprises a stereochemistry pattern of SSSSS, wherein the first S represents the first internucleotidic linkage of a provide oligonucleotide, a the 3'-end region comprises a stereochemistry pattern of SSSSS, wherein each nucleotidic unit comprising an Sp internucleotidic linkage in the 5'- or 3'-end region comprises a 2'-F sugar modification. In some embodiments, the 5'-end region comprises a stereochemistry pattern of SSSSSSS, wherein the first S represents the first internucleotidic linkage of a provide oligonucleotide, a the 3'-end region comprises a stereochemistry pattern of SSSSSSS, wherein one or more nucleotidic unit comprising an Sp internucleotidic linkage in the 5'- or 3'-end region comprise —F. In some embodiments, the 5'-end region comprises a stereochemistry pattern of SSSSSSS, wherein the first S represents the first internucleotidic linkage of a provide oligonucleotide, a the 3'-end region comprises a stereochemistry pattern of SSSSSSS, wherein one or more nucleotidic unit comprising an Sp internucleotidic linkage in the 5'- or 3'-end region comprise a 2'-F sugar modification. In some embodiments, the 5'-end region comprises a stereochemistry pattern of SSSSSSS, wherein the first S represents the first internucleotidic linkage of a provide oligonucleotide, a the 3'-end region comprises a stereochemistry pattern of SSSSSSS, wherein each nucleotidic unit comprising an Sp internucleotidic linkage in the 5'- or 3'-end region comprises —F. In some embodiments, the 5'-end region comprises a stereochemistry pattern of SSSSSSS, wherein the first S represents the first internucleotidic linkage of a provide oligonucleotide, a the 3'-end region comprises a stereochemistry pattern of SSSSSSS, wherein each nucleotidic unit comprising an Sp internucleotidic linkage in the 5'- or 3'-end region comprises a 2'-F sugar modification. In some embodiments, provided oligonucleotides further comprise a middle region between the 5'-end and 3'-end regions, e.g., a core region, which comprises one or more natural phosphate linkages. In some embodiments, provided oligonucleotides further comprise a middle region between the 5'-end and 3'-end regions, e.g., a core region, which comprises one or more natural phosphate linkages and one or more internucleotidic linkages. In some embodiments, a middle region comprises one or more sugar moieties, wherein each sugar moiety independently comprises a 2'-$OR^1$ modification. In some embodiments, a middle region comprises one or more sugar moieties comprising no 2'-F modification. In some embodiments, a middle region comprises one or more Sp internucleotidic linkages. In some embodiments, a middle region comprises one or more Sp internucleotidic linkages and one or more natural phosphate linkages. In some embodiments, a middle region comprises one or more Rp internucleotidic linkages. In some embodiments, a middle region comprises one or more Rp internucleotidic linkages and one or more natural phosphate linkages. In some embodiments, a middle region comprises one or more Rp internucleotidic linkages and one or more Sp internucleotidic linkages.

In some embodiments, provided oligonucleotides comprise one or more nucleotidic unis comprising —F in the 5'-end region, e.g., a 5'-wing. In some embodiments, provided oligonucleotides comprise two or more nucleotidic units comprising —F in the 5'-end region. In some embodiments, provided oligonucleotides comprise three or more nucleotidic units comprising —F in the 5'-end region. In some embodiments, provided oligonucleotides comprise four or more nucleotidic units comprising —F in the 5'-end region. In some embodiments, provided oligonucleotides comprise five or more nucleotidic units comprising —F in the 5'-end region. In some embodiments, provided oligonucleotides comprise six or more nucleotidic units comprising —F in the 5'-end region. In some embodiments, provided oligonucleotides comprise seven or more nucleotidic units comprising —F in the 5'-end region. In some embodiments, provided oligonucleotides comprise eight or more nucleotidic units comprising —F in the 5'-end region. In some embodiments, provided oligonucleotides comprise nine or more nucleotidic units comprising —F in the 5'-end region. In some embodiments, provided oligonucleotides comprise ten or more nucleotidic units comprising —F in the 5'-end region. In some embodiments, provided oligonucleotides comprise two or more consecutive nucleotidic units comprising —F in the 5'-end region. In some embodiments, provided oligonucleotides comprise three or more consecutive nucleotidic units comprising —F in the 5'-end region. In some embodiments, provided oligonucleotides comprise four or more consecutive nucleotidic units comprising —F in the 5'-end region. In some embodiments, provided oligonucleotides comprise five or more consecutive nucleotidic units comprising —F in the 5'-end region. In some embodiments, provided oligonucleotides comprise six or more consecutive nucleotidic units comprising —F in the 5'-end region. In some embodiments, provided oligonucleotides comprise seven or more consecutive nucleotidic units comprising —F in the 5'-end region. In some embodiments, provided oligonucleotides comprise eight or more consecutive nucleotidic units comprising —F in the 5'-end region. In some embodiments, provided oligonucleotides comprise nine or more consecutive nucleotidic units comprising —F in the 5'-end region. In some embodiments, provided oligonucleotides comprise ten or more consecutive nucleotidic units comprising —F in the 5'-end region. In some embodiments, provided oligonucleotides comprise two or more consecutive nucleotidic units comprising —F in the 5'-end region, wherein the first nucleotidic unit of the consecutive nucleotidic units is the first nucleotidic unit of the oligonucleotide. In some embodiments, provided oligonucleotides comprise three or more consecutive nucleotidic units comprising —F in the 5'-end region, wherein the first nucleotidic unit of the consecutive nucleotidic units is the first nucleotidic unit of the oligonucleotide. In some embodiments, provided oligonucleotides comprise four or more consecutive nucleotidic units comprising —F in the 5'-end region, wherein the first nucleotidic unit of the consecutive nucleotidic units is the first nucleotidic unit of the oligonucleotide. In some embodiments, provided oligonucleotides comprise five or more consecutive nucleotidic units comprising —F in the 5'-end region, wherein the first nucleotidic unit of the consecutive nucleotidic units is the first nucleotidic unit of the oligonucleotide. In some embodiments, provided oligonucleotides comprise six or more consecutive nucleotidic units comprising —F in the 5'-end region, wherein the first nucleotidic unit of the consecutive nucleotidic units is the first nucleotidic unit of the oligonucleotide. In some embodiments, provided oligonucleotides comprise seven or more consecutive nucleotidic units comprising —F in the 5'-end region, wherein the first nucleotidic unit of the consecutive nucleotidic units is the first nucleotidic unit of the oligonucleotide. In some embodiments, provided oligonucleotides comprise eight or more consecutive nucleotidic units comprising —F in the 5'-end region, wherein the first nucleotidic unit of the consecutive nucleotidic units is the first nucleotidic unit of the oligonucleotide. In some embodiments, provided oligonucleotides comprise nine or more consecutive nucleotidic units comprising —F in the 5'-end region, wherein the first nucleotidic unit of the consecutive nucleotidic units is the first nucleotidic unit of the oligonucleotide. In some embodiments, provided oligonucleotides comprise ten or more consecutive nucleotidic units comprising —F in the 5'-end region, wherein the first nucleotidic unit of the consecutive nucleotidic units is the first nucleotidic unit of the oligonucleotide. In some embodiments, provided oligonucleotides comprise one or more nucleotidic unis comprising —F in the 3'-end region, e.g., a 3'-wing. In some embodiments, provided oligonucleotides comprise two or more nucleotidic units comprising —F in the 3'-end region. In some embodiments, provided oligonucleotides comprise three or more nucleotidic units comprising —F in the 3'-end region. In some embodiments, provided oligonucleotides comprise four or more nucleotidic units comprising —F in the 3'-end region. In some embodiments, provided oligonucleotides comprise five or more nucleotidic units comprising —F in the 3'-end region. In some embodiments, provided oligonucleotides comprise six or more nucleotidic units comprising —F in the 3'-end region. In some embodiments, provided oligonucleotides comprise seven or more nucleotidic units comprising—a 3'-wing. In some embodiments, provided oligonucleotides comprise two or more nucleotidic units comprising —F in the 3'-end region. In some embodiments, provided oligonucleotides comprise tdes comprise nine or more nucleotidic units comprising —F in the 3'-end region. In some embodiments, provided oligonucleotides comprise ten or more nucleotidic units comprising —F in the 3'-end region. In some embodiments, provided oligonucleotides comprise two or more consecutive nucleotidic units comprising —F in the 3'-end region. In some embodiments, provided oligonucleotides comprise three or more consecutive nucleotidic units comprising —F in the 3'-end region. In some embodiments, provided oligonucleotides comprise four or more consecutive nucleotidic units comprising —F in the 3'-end region. In some embodiments, provided oligonucleotides comprise five or more consecutive nucleotidic units comprising —F in the 3'-end region. In some embodiments, provided oligonucleotides comprise six or more consecutive nucleotidic units comprising —F in the 3'-end region. In some embodiments, provided oligonucleotides comprise seven or more consecutive nucleotidic units comprising —F in the 3'-end region. In some embodiments, provided oligonucleotides comprise eight or more consecutive nucleotidic units comprising —F in the 3'-end region. In some embodiments, provided oligonucleotides comprise nine or more consecutive nucleotidic units comprising —F in the 3'-end region. In some embodiments, provided oligonucleotides comprise ten or more consecutive nucleotidic units comprising —F in the 3'-end region. In some embodiments, provided oligonucleotides comprise two or more consecutive nucleotidic units comprising —F in the 3'-end region, wherein the last nucleotidic unit of the consecutive nucleotidic units is the last nucleotidic unit of the oligonucleotide. In some embodiments, provided oligonucleotides comprise three or more consecutive nucleotidic units comprising —F in the 3'-end region, wherein the last nucleotidic unit of the consecutive nucleotidic units is the last nucleotidic unit of the oligonucleotide. In some embodiments, provided oligonucleotides comprise four or more consecutive nucleotidic units comprising —F in the 3'-end region, wherein the last nucleotidic unit of the consecutive nucleotidic units is the last nucleotidic unit of the oligonucleotide. In some embodiments, provided oligonucleotides comprise five or more consecutive nucleotidic units comprising —F in the 3'-end region, wherein the last nucleotidic unit of the consecutive nucleotidic units is the last nucleotidic unit of the oligonucleotide. In some embodiments, provided oligonucleotides comprise six or more consecutive nucleotidic units comprising —F in the 3'-end region, wherein the last nucleotidic unit of the consecutive nucleotidic units is the last nucleotidic unit of the oligonucleotide. In some embodiments, provided oligonucleotides comprise seven or more consecutive nucleotidic units comprising —F in the 3'-end region, wherein the last nucleotidic unit of the consecutive nucleotidic units is the last nucleotidic unit of the oligonucleotide. In some embodiments, provided oligonucleotides comprise eight or more consecutive nucleotidic units comprising —F in the 3'-end region, wherein the last nucleotidic unit of the consecutive nucleotidic units is the last nucleotidic unit of the oligonucleotide. In some embodiments, provided oligonucleotides comprise nine or more consecutive nucleotidic units comprising —F in the 3'-end region, wherein the last nucleotidic unit of the consecutive nucleotidic units is the last nucleotidic unit of the oligonucleotide. In some embodiments, provided oligonucleotides comprise ten or more consecutive nucleotidic units comprising —F in the 3'-end region, wherein the last nucleotidic unit of the consecutive nucleotidic units is the last nucleotidic unit of the oligonucleotide. In some embodiments, a nucleotidic unit comprising —F comprises a sugar moiety comprising —F. In some embodiments, each nucleotidic unit comprising —F comprises a sugar moiety comprising —F. In some embodiments, a nucleotidic unit comprising —F comprises a 2'-F modified sugar moiety. In some embodiments, each nucleotidic unit comprising —F comprises a 2'-F modified sugar moiety. In some embodiments, provided oligonucleotides comprise both a 5'-end and a 3'-end regions as described herein. In some embodiments, provided oligonucleotides comprise one or more modified internucleotidic linkages. In some embodiments, provided oligonucleotides comprise one or more chiral modified internucleotidic linkages. In some embodiments, provided oligonucleotides comprise one or more chirally controlled chiral modified internucleotidic linkages. In some embodiments, provided oligonucleotides comprise one or more natural phosphate linkages. In some embodiments, provided oligonucleotides comprise one or more modified internucleotidic linkages and one or more natural phosphate linkages. In some embodiments, a modified internucleotidic linkage is a phosphorothioate linkage. In some embodiments, each modified internucleotidic linkage is a phosphorothioate linkage.

In some embodiments, provided oligonucleotides can bind to a transcript, and change the splicing pattern of the transcript. In some embodiments, provided oligonucleotides provides exon-skipping of an exon, with efficiency greater than a comparable oligonucleotide under one or more suitable conditions, e.g., as described in FIGS. 35, 36, 37, 38, etc. In some embodiments, a provided skipping efficiency is at least 10%, 20%, 30%, 40%, 50%, 60%, 70%, 80%, 90%, 100%, 110%, 120%, 130%, 140%, 150%, 160%, 170%, 180%, 190% more than, or 2, 3, 4, 5, 6, 7, 8, 9, 10, 11, 12, 13, 14, 15, 16, 17, 18, 19, 20, 30, 40, 50 or more fold of, that of a comparable oligonucleotide under one or more suitable conditions, e.g., as described in FIGS. 35, 36, 37, 38, etc.

In some embodiments, the present disclosure demonstrates that 2'-F modifications, among other things, can improve exon-skipping efficiency. In some embodiments, the present disclosure demonstrates that Sp internucleotidic linkages, among other things, at the 5'- and 3'-ends can improve oligonucleotide stability. In some embodiments, the present disclosure demonstrates that, among other things, natural phosphate linkages and/or Rp internucleotidic linkages can improve removal of oligonucleotides from a system. As appreciated by a person having ordinary skill in the art, various assays known in the art can be utilized to assess such properties in accordance with the present disclosure.

In some embodiments, a common base sequence of a plurality of oligonucleotides comprises or consists of the base sequence of UCAAGGAAGAUGGCAUUUCU (SEQ ID NO: 54) and the plurality of oligonucleotides has a common pattern of backbone chiral centers comprising SSS, SSSS, SSSSS, SSSSSS, SSSSSSS, SOS, SSOSS, SSSOSSS, SSSSOSSSS, SSSSSOSSSSS, SSSSSSOSSSSSSS, SSSSSSSOSSSSSSS, SSSSSSSSOSSSSSSSS, SSSSSSSSSOSSSSSSSSS, SOSOSOSOS, SSOSOSOSOSS, SSSOSOSOSOSSS, SSSSOSOSOSOSSSS, SSSSSOSOSOSOSSSSS, SSSSSSOSOSOSOSSSSSS, SOSOSSOOS, SSOSOSSOOSS, SSSOSOSSOOSSS, SSSSOSOSSOOSSSS, SSSSSOSOSSOOSSSSS, SSSSSSOSOSSOOSSSSSS, SOSOOSOOS, SSOSOOSOOSS, SSSOSOOSOOSSS, SSSSOSOOSOOSSSS, SSSSSOSOOSOOSSSSS, SSSSSSOSOOSOOSSSSSS, SOSOSSOOS, SSOSOSSOOSO, SSSOSOSSOOSOS, SSSSOSOSSOOSOSS, SSSSSOSOSSOOSOSSS, SSSSSSOSOSSOOSOSSSS, SOSOOSOOSO, SSOSOOSOOSOS, SSSOSOOSOOSOS, SSSSOSOOSOOSOSS, SSSSSOSOOSOOSOSSS, SSSSSSOSOOSOOSOSSSS, SSOSOSSOO, SSSOSOSSOOS, SSSSOSOSSOOS, SSSSSOSOSSOOSS, SSSSSSOSOSSOOSSS, OSSSSSSOSOSSOOSSS, OOSSSSSSOSOSSOOS, OOSSSSSSOSOSSOOSS, OOSSSSSSOSOSSOOSSS, OOSSSSSSOSOSSOOSSSS, OOSSSSSSOSOSSOOSSSSS, and/or OOSSSSSSOSOSSOOSSSSSS, wherein O is a non-chiral internucleotidic linkage and S is an Sp internucleotidic linkage. In some embodiments, a plurality of oligonucleotides share a common base sequence comprising or consisting of the base sequence of UCAAGGAAGAUGGCAUUUCU (SEQ ID NO: 54) or 15 contiguous bases of UCAAGGAAGAUGGCAUUUCU (SEQ ID NO: 54), have a length of 40 bases or less, have a common pattern of backbone chiral centers comprising SSSS, wherein S is a phosphorothioate linkage in an Sp configuration, and further comprise one or more of the following: a phosphorothioate in the Rp configuration, a phosphodiester, or a phosphorodithioate. In some embodiments, a plurality of oligonucleotides have a common base sequence of an oligonucleotide comprising or consisting of the base sequence of UCAAGGAAGAUGGCAUUUCU (SEQ ID NO: 54) or 15 contiguous bases of UCAAGGAAGAUGGCAUUUCU (SEQ ID NO: 54), have a length of 40 bases or less, have a common pattern of backbone chiral centers comprising a sequence of SSSS, wherein S is a phosphorothioate in an Sp configuration, and further comprise one or more of the following: a phosphorothioate in the Rp configuration, a phosphodiester, or a phosphorodithioate. In some embodiments, a plurality of oligonucleotides have a common base sequence of an oligonucleotide comprising or consisting of the base sequence of UCAAGGAAGAUGGCAUUUCU (SEQ ID NO: 54) or 15 contiguous bases of UCAAGGAAGAUGGCAUUUCU (SEQ ID NO: 54), have a length of 40 bases or less, have a common pattern of backbone chiral centers comprising 4 phosphorothioates in an Sp configuration, wherein the 4 phosphorothioates in an Sp configuration may be contiguous or non-contiguous, and further comprise one or more of the following: a phosphorothioate in the Rp configuration, a phosphodiester, or a phosphorodithioate. In some embodiments, a plurality of oligonucleotides have a common base sequence of an oligonucleotide comprising or consisting of the base sequence of UCAAGGAAGAUGGCAUUUCU (SEQ ID NO: 54) or 15 contiguous bases of UCAAGGAAGAUGGCAUUUCU (SEQ ID NO: 54), have a length of 40 bases or less, have a common pattern of backbone chiral centers comprising 5 phosphorothioates in an Sp configuration, wherein the 5 phosphorothioates in an Sp configuration may be contiguous or non-contiguous, and further comprise 2 or more of the following: a phosphorothioate in the Rp configuration, a phosphodiester, or a phosphorodithioate.

In some embodiments, provided oligonucleotides comprise one or more modified sugar moieties. In some embodiments, provided oligonucleotides comprise one or more modified sugar moieties. In some embodiments, provided oligonucleotides comprise 2 or more modified sugar moieties. In some embodiments, provided oligonucleotides comprise 3 or more modified sugar moieties. In some embodiments, provided oligonucleotides comprise 4 or more modified sugar moieties. In some embodiments, provided oligonucleotides comprise 5 or more modified sugar moieties. In some embodiments, provided oligonucleotides comprise 6 or more modified sugar moieties. In some embodiments, provided oligonucleotides comprise 7 or more modified sugar moieties. In some embodiments, provided oligonucleotides comprise 8 or more modified sugar moieties. In some embodiments, provided oligonucleotides comprise 9 or more modified sugar moieties. In some embodiments, provided oligonucleotides comprise 10 or more modified sugar moieties. In some embodiments, provided oligonucleotides comprise 11 or more modified sugar moieties. In some embodiments, provided oligonucleotides comprise 12 or more modified sugar moieties. In some embodiments, provided oligonucleotides comprise 13 or more modified sugar moieties. In some embodiments, provided oligonucleotides comprise 14 or more modified sugar moieties. In some embodiments, provided oligonucleotides comprise 15 or more modified sugar moieties. In some embodiments, provided oligonucleotides comprise 15 or more modified sugar moieties. In some embodiments, provided oligonucleotides comprise 16 or more modified sugar moieties. In some embodiments, provided oligonucleotides comprise 17 or more modified sugar moieties. In some embodiments, provided oligonucleotides comprise 18 or more modified sugar moieties. In some embodiments, provided oligonucleotides comprise 19 or more modified sugar moieties. In some embodiments, provided oligonucleotides comprise 20 or more modified sugar moieties. In some embodiments, provided oligonucleotides comprise 21 or more modified sugar moieties. In some embodiments, provided oligonucleotides comprise 22 or more modified sugar moieties. In some embodiments, provided oligonucleotides comprise 23 or more modified sugar moieties. In some embodiments, provided oligonucleotides comprise 24 or more modified sugar moieties. In some embodiments, provided oligonucleotides comprise 25 or more modified sugar moieties. In some embodiments, provided oligonucleotides comprise 30 or more modified sugar moieties. In some embodiments, a modified sugar moiety comprises a 2'-modification. In some embodiments, a modified sugar moiety comprises a 2'-modification. In some embodiments, a 2'-modification is 2'-$OR^1$. In some embodiments, a 2'-modification is a 2'-OMe. In some embodiments, a 2'-modification is a 2'-MOE. In some embodiments, a 2'-modification is an LNA sugar modification. In some embodiments, a 2'-modification is 2'-F. In some embodiments, each sugar modification is independently a 2'-modification. In some embodiments, each sugar modification is independently $2'-OR^1$ or 2'-F. In some embodiments, each sugar modification is independently $2'-OR^1$ or 2'-F, wherein $R^1$ is optionally substituted $C_{1-6}$ alkyl. In some embodiments, each sugar modification is independently $2'-OR^1$ or 2'-F, wherein at least one is 2'-F. In some embodiments, each sugar modification is independently $2'-OR^1$ or 2'-F, wherein $R^1$ is optionally substituted $C_{1-6}$ alkyl, and wherein at least one is $2'-OR^1$. In some embodiments, each sugar modification is independently $2'-OR^1$ or 2'-F, wherein at least one is 2'-F, and at least one is $2'-OR^1$. In some embodiments, each sugar modification is independently $2'-OR^1$ or 2'-F, wherein $R^1$ is optionally substituted $C_{1-6}$ alkyl, and wherein at least one is 2'-F, and at least one is $2'-OR^1$.

In some embodiments, 5% or more of the sugar moieties of provided oligonucleotides are modified. In some embodiments, 10% or more of the sugar moieties of provided oligonucleotides are modified. In some embodiments, 15% or more of the sugar moieties of provided oligonucleotides are modified. In some embodiments, 20% or more of the sugar moieties of provided oligonucleotides are modified. In some embodiments, 25% or more of the sugar moieties of provided oligonucleotides are modified. In some embodiments, 30% or more of the sugar moieties of provided oligonucleotides are modified. In some embodiments, 35% or more of the sugar moieties of provided oligonucleotides are modified. In some embodiments, 40% or more of the sugar moieties of provided oligonucleotides are modified. In some embodiments, 45% or more of the sugar moieties of provided oligonucleotides are modified. In some embodiments, 50% or more of the sugar moieties of provided oligonucleotides are modified. In some embodiments, 55% or more of the sugar moieties of provided oligonucleotides are modified. In some embodiments, 60% or more of the sugar moieties of provided oligonucleotides are modified. In some embodiments, 65% or more of the sugar moieties of provided oligonucleotides are modified. In some embodiments, 70% or more of the sugar moieties of provided oligonucleotides are modified. In some embodiments, 75% or more of the sugar moieties of provided oligonucleotides are modified. In some embodiments, 80% or more of the sugar moieties of provided oligonucleotides are modified. In some embodiments, 85% or more of the sugar moieties of provided oligonucleotides are modified. In some embodiments, 90% or more of the sugar moieties of provided oligonucleotides are modified. In some embodiments, 95% or more of the sugar moieties of provided oligonucleotides are modified. In some embodiments, each sugar moiety of provided oligonucleotides is modified. In some embodiments, a modified sugar moiety comprises a 2'-modification. In some embodiments, a modified sugar moiety comprises a 2'-modification. In some embodiments, a 2'-modification is $2'-OR^1$. In some embodiments, a 2'-modification is a 2'-OMe. In some embodiments, a 2'-modification is a 2'-MOE. In some embodiments, a 2'-modification is an LNA sugar modification. In some embodiments, a 2'-modification is 2'-F. In some embodiments, each sugar modification is independently a 2'-modification. In some embodiments, each sugar modification is independently $2'-OR^1$ or 2'-F. In some embodiments, each sugar modification is independently $2'-OR^1$ or 2'-F, wherein $R^1$ is optionally substituted $C_{1-6}$ alkyl. In some embodiments, each sugar modification is independently $2'-OR^1$ or 2'-F, wherein at least one is 2'-F. In some embodiments, each sugar modification is independently $2'-OR^1$ or 2'-F, wherein $R^1$ is optionally substituted $C_{1-6}$ alkyl, and wherein at least one is $2'-OR^1$. In some embodiments, each sugar modification is independently $2'-OR^1$ or 2'-F, wherein at least one is 2'-F, and at least one is $2'-OR^1$. In some embodiments, each sugar modification is independently $2'-OR^1$ or 2'-F, wherein $R^1$ is optionally substituted $C_{1-6}$ alkyl, and wherein at least one is 2'-F, and at least one is $2'-OR^1$.

In some embodiments, provided oligonucleotides comprise one or more 2'-F. In some embodiments, provided oligonucleotides comprise two or more 2'-F. In some embodiments, provided oligonucleotides comprise three or more 2'-F. In some embodiments, provided oligonucleotides comprise four or more 2'-F. In some embodiments, provided oligonucleotides comprise five or more 2'-F. In some embodiments, provided oligonucleotides comprise six or more 2'-F. In some embodiments, provided oligonucleotides comprise seven or more 2'-F. In some embodiments, provided oligonucleotides comprise eight or more 2'-F. In some embodiments, provided oligonucleotides comprise nine or more 2'-F. In some embodiments, provided oligonucleotides comprise ten or more 2'-F. In some embodiments, provided oligonucleotides comprise 11 or more 2'-F. In some embodiments, provided oligonucleotides comprise 12 or more 2'-F. In some embodiments, provided oligonucleotides comprise 13 or more 2'-F. In some embodiments, provided oligonucleotides comprise 14 or more 2'-F. In some embodiments, provided oligonucleotides comprise 15 or more 2'-F. In some embodiments, provided oligonucleotides comprise 16 or more 2'-F. In some embodiments, provided oligonucleotides comprise 17 or more 2'-F. In some embodiments, provided oligonucleotides comprise 18 or more 2'-F. In some embodiments, provided oligonucleotides comprise 19 or more 2'-F. In some embodiments, provided oligonucleotides comprise 20 or more 2'-F. In some embodiments, provided oligonucleotides comprise 21 or more 2'-F. In some embodiments, provided oligonucleotides comprise 22 or more 2'-F. In some embodiments, provided oligonucleotides comprise 23 or more 2'-F. In some embodiments, provided oligonucleotides comprise 24 or more 2'-F. In some embodiments, provided oligonucleotides comprise 25 or more 2'-F. In some embodiments, provided oligonucleotides comprise 30 or more 2'-F. In some embodiments, provided oligonucleotides comprise 35 or more 2'-F.

In some embodiments, provided oligonucleotides comprise one 2'-F. In some embodiments, provided oligonucleotides comprise two 2'-F. In some embodiments, provided oligonucleotides comprise three 2'-F. In some embodiments, provided oligonucleotides comprise four 2'-F. In some embodiments, provided oligonucleotides comprise five 2'-F. In some embodiments, provided oligonucleotides comprise six 2'-F. In some embodiments, provided oligonucleotides comprise seven 2'-F. In some embodiments, provided oligonucleotides comprise eight 2'-F. In some embodiments, provided oligonucleotides comprise nine 2'-F. In some embodiments, provided oligonucleotides comprise ten 2'-F. In some embodiments, provided oligonucleotides comprise 11 2'-F. In some embodiments, provided oligonucleotides comprise 12 2'-F. In some embodiments, provided oligonucleotides comprise 13 2'-F. In some embodiments, provided oligonucleotides comprise 14 2'-F. In some embodiments, provided oligonucleotides comprise 15 2'-F. In some embodiments, provided oligonucleotides comprise 16 2'-F. In some embodiments, provided oligonucleotides comprise 17 2'-F. In some embodiments, provided oligonucleotides comprise 18 2'-F. In some embodiments, provided oligonucleotides comprise 19 2'-F. In some embodiments, provided oligonucleotides comprise 20 2'-F. In some embodiments, provided oligonucleotides comprise 21 2'-F. In some embodiments, provided oligonucleotides comprise 22 2'-F. In some embodiments, provided oligonucleotides comprise 23 2'-F. In some embodiments, provided oligonucleotides comprise 24 2'-F. In some embodiments, provided oligonucleotides comprise 25 2'-F. In some embodiments, provided oligonucleotides comprise 30 2'-F. In some embodiments, provided oligonucleotides comprise 35 2'-F.

In some embodiments, provided oligonucleotides comprise one or more consecutive 2'-F. In some embodiments, provided oligonucleotides comprise two or more consecutive 2'-F. In some embodiments, provided oligonucleotides comprise three or more consecutive 2'-F. In some embodiments, provided oligonucleotides comprise four or more consecutive 2'-F. In some embodiments, provided oligonucleotides comprise five or more consecutive 2'-F. In some embodiments, provided oligonucleotides comprise six or more consecutive 2'-F. In some embodiments, provided oligonucleotides comprise seven or more consecutive 2'-F. In some embodiments, provided oligonucleotides comprise eight or more consecutive 2'-F. In some embodiments, provided oligonucleotides comprise nine or more consecutive 2'-F. In some embodiments, provided oligonucleotides comprise ten or more consecutive 2'-F. In some embodiments, provided oligonucleotides comprise 11 or more consecutive 2'-F. In some embodiments, provided oligonucleotides comprise 12 or more consecutive 2'-F. In some embodiments, provided oligonucleotides comprise 13 or more consecutive 2'-F. In some embodiments, provided oligonucleotides comprise 14 or more consecutive 2'-F. In some embodiments, provided oligonucleotides comprise 15 or more consecutive 2'-F. In some embodiments, provided oligonucleotides comprise 16 or more consecutive 2'-F. In some embodiments, provided oligonucleotides comprise 17 or more consecutive 2'-F. In some embodiments, provided oligonucleotides comprise 18 or more consecutive 2'-F. In some embodiments, provided oligonucleotides comprise 19 or more consecutive 2'-F. In some embodiments, provided oligonucleotides comprise 20 or more consecutive 2'-F. In some embodiments, provided oligonucleotides comprise 21 or more consecutive 2'-F. In some embodiments, provided oligonucleotides comprise 22 or more consecutive 2'-F. In some embodiments, provided oligonucleotides comprise 23 or more consecutive 2'-F. In some embodiments, provided oligonucleotides comprise 24 or more consecutive 2'-F. In some embodiments, provided oligonucleotides comprise 25 or more consecutive 2'-F. In some embodiments, provided oligonucleotides comprise 30 or more consecutive 2'-F. In some embodiments, provided oligonucleotides comprise 35 or more consecutive 2'-F.

In some embodiments, provided oligonucleotides comprise one consecutive 2'-F. In some embodiments, provided oligonucleotides comprise two consecutive 2'-F. In some embodiments, provided oligonucleotides comprise three consecutive 2'-F. In some embodiments, provided oligonucleotides comprise four consecutive 2'-F. In some embodiments, provided oligonucleotides comprise five consecutive 2'-F. In some embodiments, provided oligonucleotides comprise six consecutive 2'-F. In some embodiments, provided oligonucleotides comprise seven consecutive 2'-F. In some embodiments, provided oligonucleotides comprise eight consecutive 2'-F. In some embodiments, provided oligonucleotides comprise nine consecutive 2'-F. In some embodiments, provided oligonucleotides comprise ten consecutive 2'-F. In some embodiments, provided oligonucleotides comprise 11 consecutive 2'-F. In some embodiments, provided oligonucleotides comprise 12 consecutive 2'-F. In some embodiments, provided oligonucleotides comprise 13 consecutive 2'-F. In some embodiments, provided oligonucleotides comprise 14 consecutive 2'-F. In some embodiments, provided oligonucleotides comprise 15 consecutive 2'-F. In some embodiments, provided oligonucleotides comprise 16 consecutive 2'-F. In some embodiments, provided oligonucleotides comprise 17 consecutive 2'-F. In some embodiments, provided oligonucleotides comprise 18 consecutive 2'-F. In some embodiments, provided oligonucleotides comprise 19 consecutive 2'-F. In some embodiments, provided oligonucleotides comprise 20 consecutive 2'-F. In some embodiments, provided oligonucleotides comprise 21 consecutive 2'-F. In some embodiments, provided oligonucleotides comprise 22 consecutive 2'-F. In some embodiments, provided oligonucleotides comprise 23 consecutive 2'-F. In some embodiments, provided oligonucleotides comprise 24 consecutive 2'-F. In some embodiments, provided oligonucleotides comprise 25 consecutive 2'-F. In some embodiments, provided oligonucleotides comprise 30 consecutive 2'-F. In some embodiments, provided oligonucleotides comprise 35 consecutive 2'-F.

In some embodiments, a nucleoside comprising a 2'-modification is followed by a modified internucleotidic linkage. In some embodiments, a nucleoside comprising a 2'-modification is preceded by a modified internucleotidic linkage. In some embodiments, a modified internucleotidic linkage is a chiral internucleotidic linkage. In some embodiments, a modified internucleotidic linkage is a phosphorothioate. In some embodiments, a chiral internucleotidic linkage is Sp. In some embodiments, a nucleoside comprising a 2'-modification is followed by an Sp chiral internucleotidic linkage. In some embodiments, a nucleoside comprising a 2'-F is followed by an Sp chiral internucleotidic linkage. In some embodiments, a nucleoside comprising a 2'-modification is preceded by an Sp chiral internucleotidic linkage. In some embodiments, a nucleoside comprising a 2'-F is preceded by an Sp chiral internucleotidic linkage. In some embodiments, a chiral internucleotidic linkage is Rp. In some embodiments, a nucleoside comprising a 2'-modification is followed by an Rp chiral internucleotidic linkage. In some embodiments, a nucleoside comprising a 2'-F is followed by an Rp chiral internucleotidic linkage. In some embodiments, a nucleoside comprising a 2'-modification is preceded by an Rp chiral internucleotidic linkage. In some embodiments, a nucleoside comprising a 2'-F is preceded by an Rp chiral internucleotidic linkage.

In some embodiments, provided oligonucleotides comprise alternating 2'-F modified sugar moieties and 2'-$OR^1$ modified sugar moieties. In some embodiments, provided oligonucleotides comprise alternating 2'-F modified sugar moieties and 2'-OMe modified sugar moieties, e.g., [(2'-F)(2'-OMe)]x, [(2'-OMe)(2'-F)]x, etc., wherein x is 1-50. In some embodiments, provided oligonucleotides comprise at least two pairs of alternating 2'-F and 2'-OMe modifications. In some embodiments, provided oligonucleotides comprises alternating phosphodiester and phosphorothioate internucleotidic linkages, e.g., [(PO)(PS)]x, [(PS)(PO)]x, etc., wherein x is 1-50. In some embodiments, provided oligonucleotides comprise at least two pairs of alternating phosphodiester and phosphorothioate internucleotidic linkages.

In some embodiments, provided oligonucleotides comprise one or more natural phosphate linkages and one or more modified internucleotidic linkages.

Provided oligonucleotides can comprise various number of natural phosphate linkages. In some embodiments, provided oligonucleotides comprise no natural phosphate linkages. In some embodiments, provided oligonucleotides comprise one natural phosphate linkage. In some embodiments, provided oligonucleotides comprise 2 or more natural phosphate linkages. In some embodiments, provided oligonucleotides comprise 3 or more natural phosphate linkages. In some embodiments, provided oligonucleotides comprise 4 or more natural phosphate linkages. In some embodiments, provided oligonucleotides comprise 5 or more natural phosphate linkages. In some embodiments, provided oligonucleotides comprise 6 or more natural phosphate linkages. In some embodiments, provided oligonucleotides comprise 7 or more natural phosphate linkages. In some embodiments, provided oligonucleotides comprise 8 or more natural phosphate linkages. In some embodiments, provided oligonucleotides comprise 9 or more natural phosphate linkages. In some embodiments, provided oligonucleotides comprise 10 or more natural phosphate linkages. In some embodiments, provided oligonucleotides comprise 15 or more natural phosphate linkages. In some embodiments, provided oligonucleotides comprise 20 or more natural phosphate linkages. In some embodiments, provided oligonucleotides comprise 25 or more natural phosphate linkages. In some embodiments, provided oligonucleotides comprise 30 or more natural phosphate linkages.

In some embodiments, 5% or more of the internucleotidic linkages of provided oligonucleotides are natural phosphate linkages. In some embodiments, 10% or more of the internucleotidic linkages of provided oligonucleotides are natural phosphate linkages. In some embodiments, 15% or more of the internucleotidic linkages of provided oligonucleotides are natural phosphate linkages. In some embodiments, 20% or more of the internucleotidic linkages of provided oligonucleotides are natural phosphate linkages. In some embodiments, 25% or more of the internucleotidic linkages of provided oligonucleotides are natural phosphate linkages. In some embodiments, 30% or more of the internucleotidic linkages of provided oligonucleotides are natural phosphate linkages. In some embodiments, 35% or more of the internucleotidic linkages of provided oligonucleotides are natural phosphate linkages. In some embodiments, 40% or more of the internucleotidic linkages of provided oligonucleotides are natural phosphate linkages. In some embodiments, 45% or more of the internucleotidic linkages of a wing region are natural phosphate linkages. In some embodiments, 50% or more of the internucleotidic linkages of a wing region are natural phosphate linkages. In some embodiments, 55% or more of the internucleotidic linkages of a wing region are natural phosphate linkages. In some embodiments, 60% or more of the internucleotidic linkages of a wing region are natural phosphate linkages. In some embodiments, 65% or more of the internucleotidic linkages of a wing region are natural phosphate linkages. In some embodiments, 70% or more of the internucleotidic linkages of a wing region are natural phosphate linkages. In some embodiments, 75% or more of the internucleotidic linkages of a wing region are natural phosphate linkages. In some embodiments, 80% or more of the internucleotidic linkages of a wing region are natural phosphate linkages. In some embodiments, 85% or more of the internucleotidic linkages of a wing region are natural phosphate linkages. In some embodiments, 90% or more of the internucleotidic linkages of a wing region are natural phosphate linkages. In some embodiments, 95% or more of the internucleotidic linkages of a wing region are natural phosphate linkages. In some embodiments, each internucleotidic linkage of a wing region is a natural phosphate linkage.

In some embodiments, a core region comprises 2 or more modified internucleotidic linkages. In some embodiments, a core region comprises 3 or more modified internucleotidic linkages. In some embodiments, a core region comprises 4 or more modified internucleotidic linkages. In some embodiments, a core region comprises 5 or more modified internucleotidic linkages. In some embodiments, a core region comprises 6 or more modified internucleotidic linkages. In some embodiments, a core region comprises 7 or more modified internucleotidic linkages. In some embodiments, a core region comprises 8 or more modified internucleotidic linkages. In some embodiments, a core region comprises 9 or more modified internucleotidic linkages. In some embodiments, a core region comprises 10 or more modified internucleotidic linkages. In some embodiments, a core region comprises 11 or more modified internucleotidic linkages. In some embodiments, a core region comprises 12 or more modified internucleotidic linkages. In some embodiments, a core region comprises 13 or more modified internucleotidic linkages. In some embodiments, a core region comprises 14 or more modified internucleotidic linkages. In some embodiments, a core region comprises 15 or more modified internucleotidic linkages. In some embodiments, a core region comprises 2 or consecutive modified internucleotidic linkages. In some embodiments, a core region comprises 3 or consecutive modified internucleotidic linkages. In some embodiments, a core region comprises 4 or consecutive modified internucleotidic linkages. In some embodiments, a core region comprises 5 or consecutive modified internucleotidic linkages. In some embodiments, a core region comprises 6 or consecutive modified internucleotidic linkages. In some embodiments, a core region comprises 7 or consecutive modified internucleotidic linkages. In some embodiments, a core region comprises 8 or consecutive modified internucleotidic linkages. In some embodiments, a core region comprises 9 or consecutive modified internucleotidic linkages. In some embodiments, a core region comprises 10 or consecutive modified internucleotidic linkages. In some embodiments, a core region comprises 11 or consecutive modified internucleotidic linkages. In some embodiments, a core region comprises 12 or consecutive modified internucleotidic linkages. In some embodiments, a core region comprises 13 or consecutive modified internucleotidic linkages. In some embodiments, a core region comprises 14 or consecutive modified internucleotidic linkages. In some embodiments, a core region comprises 15 or consecutive modified internucleotidic linkages. In some embodiments, each internucleotidic linkage in a core region is independently a modified internucleotidic linkage.

In some embodiments, 5% or more of the internucleotidic linkages of provided oligonucleotides are modified internucleotidic linkages. In some embodiments, 10% or more of the internucleotidic linkages of provided oligonucleotides are modified internucleotidic linkages. In some embodiments, 15% or more of the internucleotidic linkages of provided oligonucleotides are modified internucleotidic linkages. In some embodiments, 20% or more of the internucleotidic linkages of provided oligonucleotides are modified internucleotidic linkages. In some embodiments, 25% or more of the internucleotidic linkages of provided oligonucleotides are modified internucleotidic linkages. In some embodiments, 30% or more of the internucleotidic linkages of provided oligonucleotides are modified internucleotidic linkages. In some embodiments, 35% or more of the internucleotidic linkages of provided oligonucleotides are modified internucleotidic linkages. In some embodiments, 40% or more of the internucleotidic linkages of provided oligonucleotides are modified internucleotidic linkages. In some embodiments, 45% or more of the internucleotidic linkages of a core region are modified internucleotidic linkages. In some embodiments, 50% or more of the internucleotidic linkages of a core region are modified internucleotidic linkages. In some embodiments, 55% or more of the internucleotidic linkages of a core region are modified internucleotidic linkages. In some embodiments, 60% or more of the internucleotidic linkages of a core region are modified internucleotidic linkages. In some embodiments, 65% or more of the internucleotidic linkages of a core region are modified internucleotidic linkages. In some embodiments, 70% or more of the internucleotidic linkages of a core region are modified internucleotidic linkages. In some embodiments, 75% or more of the internucleotidic linkages of a core region are modified internucleotidic linkages. In some embodiments, 80% or more of the internucleotidic linkages of a core region are modified internucleotidic linkages. In some embodiments, 85% or more of the internucleotidic linkages of a core region are modified internucleotidic linkages. In some embodiments, 90% or more of the internucleotidic linkages of a core region are modified internucleotidic linkages. In some embodiments, 95% or more of the internucleotidic linkages of a core region are modified internucleotidic linkages. In some embodiments, each internucleotidic linkage of a core region is a modified internucleotidic linkage.

In some embodiments, the present disclosure provides an oligonucleotide composition comprising a first plurality of oligonucleotides, wherein:

- oligonucleotides of the first plurality have the same base sequence; and
- oligonucleotides of the first plurality comprise one or more modified sugar moieties, or comprise one or more natural phosphate linkages and one or more modified internucleotidic linkages.

In some embodiments, oligonucleotides of the first plurality comprise one or more modified sugar moieties. In some embodiments, provided oligonucleotides comprise one or more modified sugar moieties. In some embodiments, provided oligonucleotides comprise 2 or more modified sugar moieties. In some embodiments, provided oligonucleotides comprise 3 or more modified sugar moieties. In some embodiments, provided oligonucleotides comprise 4 or more modified sugar moieties. In some embodiments, provided oligonucleotides comprise 5 or more modified sugar moieties. In some embodiments, provided oligonucleotides comprise 6 or more modified sugar moieties. In some embodiments, provided oligonucleotides comprise 7 or more modified sugar moieties. In some embodiments, provided oligonucleotides comprise 8 or more modified sugar moieties. In some embodiments, provided oligonucleotides comprise 9 or more modified sugar moieties. In some embodiments, provided oligonucleotides comprise 10 or more modified sugar moieties. In some embodiments, provided oligonucleotides comprise 15 or more modified sugar moieties. In some embodiments, provided oligonucleotides comprise 20 or more modified sugar moieties. In some embodiments, provided oligonucleotides comprise 25 or more modified sugar moieties. In some embodiments, provided oligonucleotides comprise 30 or more modified sugar moieties.

In some embodiments, 5% or more of the sugar moieties of provided oligonucleotides are modified. In some embodiments, 10% or more of the sugar moieties of provided oligonucleotides are modified. In some embodiments, 15% or more of the sugar moieties of provided oligonucleotides are modified. In some embodiments, 20% or more of the sugar moieties of provided oligonucleotides are modified. In some embodiments, 25% or more of the sugar moieties of provided oligonucleotides are modified. In some embodiments, 30% or more of the sugar moieties of provided oligonucleotides are modified. In some embodiments, 35% or more of the sugar moieties of provided oligonucleotides are modified. In some embodiments, 40% or more of the sugar moieties of provided oligonucleotides are modified. In some embodiments, 45% or more of the sugar moieties of provided oligonucleotides are modified. In some embodiments, 50% or more of the sugar moieties of provided oligonucleotides are modified. In some embodiments, 55% or more of the sugar moieties of provided oligonucleotides are modified. In some embodiments, 60% or more of the sugar moieties of provided oligonucleotides are modified. In some embodiments, 65% or more of the sugar moieties of provided oligonucleotides are modified. In some embodiments, 70% or more of the sugar moieties of provided oligonucleotides are modified. In some embodiments, 75% or more of the sugar moieties of provided oligonucleotides are modified. In some embodiments, 80% or more of the sugar moieties of provided oligonucleotides are modified. In some embodiments, 85% or more of the sugar moieties of provided oligonucleotides are modified. In some embodiments, 90% or more of the sugar moieties of provided oligonucleotides are modified. In some embodiments, 95% or more of the sugar moieties of provided oligonucleotides are modified. In some embodiments, each sugar moiety of provided oligonucleotides is modified.

In some embodiments, provided oligonucleotides comprise one or more 2'-F. In some embodiments, provided oligonucleotides comprise two or more 2'-F. In some embodiments, provided oligonucleotides comprise three or more 2'-F. In some embodiments, provided oligonucleotides comprise four or more 2'-F. In some embodiments, provided oligonucleotides comprise five or more 2'-F. In some embodiments, provided oligonucleotides comprise six or more 2'-F. In some embodiments, provided oligonucleotides comprise seven or more 2'-F. In some embodiments, provided oligonucleotides comprise eight or more 2'-F. In some embodiments, provided oligonucleotides comprise nine or more 2'-F. In some embodiments, provided oligonucleotides comprise ten or more 2'-F. In some embodiments, provided oligonucleotides comprise 11 or more 2'-F. In some embodiments, provided oligonucleotides comprise 12 or more 2'-F. In some embodiments, provided oligonucleotides comprise 13 or more 2'-F. In some embodiments, provided oligonucleotides comprise 14 or more 2'-F. In some embodiments, provided oligonucleotides comprise 15 or more 2'-F. In some embodiments, provided oligonucleotides comprise 16 or more 2'-F. In some embodiments, provided oligonucleotides comprise 17 or more 2'-F. In some embodiments, provided oligonucleotides comprise 18 or more 2'-F. In some embodiments, provided oligonucleotides comprise 19 or more 2'-F. In some embodiments, provided oligonucleotides comprise 20 or more 2'-F. In some embodiments, provided oligonucleotides comprise 21 or more 2'-F. In some embodiments, provided oligonucleotides comprise 22 or more 2'-F. In some embodiments, provided oligonucleotides comprise 23 or more 2'-F. In some embodiments, provided oligonucleotides comprise 24 or more 2'-F. In some embodiments, provided oligonucleotides comprise 25 or more 2'-F. In some embodiments, provided oligonucleotides comprise 30 or more 2'-F. In some embodiments, provided oligonucleotides comprise 35 or more 2'-F.

In some embodiments, provided oligonucleotides comprise one 2'-F. In some embodiments, provided oligonucleotides comprise two 2'-F. In some embodiments, provided oligonucleotides comprise three 2'-F. In some embodiments, provided oligonucleotides comprise four 2'-F. In some embodiments, provided oligonucleotides comprise five 2'-F.

In some embodiments, provided oligonucleotides comprise six 2'-F. In some embodiments, provided oligonucleotides comprise seven 2'-F. In some embodiments, provided oligonucleotides comprise eight 2'-F. In some embodiments, provided oligonucleotides comprise nine 2'-F. In some embodiments, provided oligonucleotides comprise ten 2'-F. In some embodiments, provided oligonucleotides comprise 11 2'-F. In some embodiments, provided oligonucleotides comprise 12 2'-F. In some embodiments, provided oligonucleotides comprise 13 2'-F. In some embodiments, provided oligonucleotides comprise 14 2'-F. In some embodiments, provided oligonucleotides comprise 15 2'-F. In some embodiments, provided oligonucleotides comprise 16 2'-F. In some embodiments, provided oligonucleotides comprise 17 2'-F. In some embodiments, provided oligonucleotides comprise 18 2'-F. In some embodiments, provided oligonucleotides comprise 19 2'-F. In some embodiments, provided oligonucleotides comprise 20 2'-F. In some embodiments, provided oligonucleotides comprise 21 2'-F. In some embodiments, provided oligonucleotides comprise 22 2'-F. In some embodiments, provided oligonucleotides comprise 23 2'-F. In some embodiments, provided oligonucleotides comprise 24 2'-F. In some embodiments, provided oligonucleotides comprise 25 2'-F. In some embodiments, provided oligonucleotides comprise 30 2'-F. In some embodiments, provided oligonucleotides comprise 35 2'-F.

In some embodiments, provided oligonucleotides comprise one or more consecutive 2'-F. In some embodiments, provided oligonucleotides comprise two or more consecutive 2'-F. In some embodiments, provided oligonucleotides comprise three or more consecutive 2'-F. In some embodiments, provided oligonucleotides comprise four or more consecutive 2'-F. In some embodiments, provided oligonucleotides comprise five or more consecutive 2'-F. In some embodiments, provided oligonucleotides comprise six or more consecutive 2'-F. In some embodiments, provided oligonucleotides comprise seven or more consecutive 2'-F. In some embodiments, provided oligonucleotides comprise eight or more consecutive 2'-F. In some embodiments, provided oligonucleotides comprise nine or more consecutive 2'-F. In some embodiments, provided oligonucleotides comprise ten or more consecutive 2'-F. In some embodiments, provided oligonucleotides comprise 11 or more consecutive 2'-F. In some embodiments, provided oligonucleotides comprise 12 or more consecutive 2'-F. In some embodiments, provided oligonucleotides comprise 13 or more consecutive 2'-F. In some embodiments, provided oligonucleotides comprise 14 or more consecutive 2'-F. In some embodiments, provided oligonucleotides comprise 15 or more consecutive 2'-F. In some embodiments, provided oligonucleotides comprise 16 or more consecutive 2'-F. In some embodiments, provided oligonucleotides comprise 17 or more consecutive 2'-F. In some embodiments, provided oligonucleotides comprise 18 or more consecutive 2'-F. In some embodiments, provided oligonucleotides comprise 19 or more consecutive 2'-F. In some embodiments, provided oligonucleotides comprise 20 or more consecutive 2'-F. In some embodiments, provided oligonucleotides comprise 21 or more consecutive 2'-F. In some embodiments, provided oligonucleotides comprise 22 or more consecutive 2'-F. In some embodiments, provided oligonucleotides comprise 23 or more consecutive 2'-F. In some embodiments, provided oligonucleotides comprise 24 or more consecutive 2'-F. In some embodiments, provided oligonucleotides comprise 25 or more consecutive 2'-F. In some embodiments, provided oligonucleotides comprise 30 or more consecutive 2'-F. In some embodiments, provided oligonucleotides comprise 35 or more consecutive 2'-F.

In some embodiments, provided oligonucleotides comprise one consecutive 2'-F. In some embodiments, provided oligonucleotides comprise two consecutive 2'-F. In some embodiments, provided oligonucleotides comprise three consecutive 2'-F. In some embodiments, provided oligonucleotides comprise four consecutive 2'-F. In some embodiments, provided oligonucleotides comprise five consecutive 2'-F. In some embodiments, provided oligonucleotides comprise six consecutive 2'-F. In some embodiments, provided oligonucleotides comprise seven consecutive 2'-F. In some embodiments, provided oligonucleotides comprise eight consecutive 2'-F. In some embodiments, provided oligonucleotides comprise nine consecutive 2'-F. In some embodiments, provided oligonucleotides comprise ten consecutive 2'-F. In some embodiments, provided oligonucleotides comprise 11 consecutive 2'-F. In some embodiments, provided oligonucleotides comprise 12 consecutive 2'-F. In some embodiments, provided oligonucleotides comprise 13 consecutive 2'-F. In some embodiments, provided oligonucleotides comprise 14 consecutive 2'-F. In some embodiments, provided oligonucleotides comprise 15 consecutive 2'-F. In some embodiments, provided oligonucleotides comprise 16 consecutive 2'-F. In some embodiments, provided oligonucleotides comprise 17 consecutive 2'-F. In some embodiments, provided oligonucleotides comprise 18 consecutive 2'-F. In some embodiments, provided oligonucleotides comprise 19 consecutive 2'-F. In some embodiments, provided oligonucleotides comprise 20 consecutive 2'-F. In some embodiments, provided oligonucleotides comprise 21 consecutive 2'-F. In some embodiments, provided oligonucleotides comprise 22 consecutive 2'-F. In some embodiments, provided oligonucleotides comprise 23 consecutive 2'-F. In some embodiments, provided oligonucleotides comprise 24 consecutive 2'-F. In some embodiments, provided oligonucleotides comprise 25 consecutive 2'-F. In some embodiments, provided oligonucleotides comprise 30 consecutive 2'-F. In some embodiments, provided oligonucleotides comprise 35 consecutive 2'-F.

In some embodiments, a nucleoside comprising a 2'-modification is followed by a modified internucleotidic linkage. In some embodiments, a nucleoside comprising a 2'-modification is preceded by a modified internucleotidic linkage. In some embodiments, a modified internucleotidic linkage is a chiral internucleotidic linkage. In some embodiments, a modified internucleotidic linkage is a phosphorothioate. In some embodiments, a chiral internucleotidic linkage is Sp. In some embodiments, a nucleoside comprising a 2'-modification is followed by an Sp chiral internucleotidic linkage. In some embodiments, a nucleoside comprising a 2'-F is followed by an Sp chiral internucleotidic linkage. In some embodiments, a nucleoside comprising a 2'-modification is preceded by an Sp chiral internucleotidic linkage. In some embodiments, a nucleoside comprising a 2'-F is preceded by an Sp chiral internucleotidic linkage. In some embodiments, a chiral internucleotidic linkage is Rp. In some embodiments, a nucleoside comprising a 2'-modification is followed by an Rp chiral internucleotidic linkage. In some embodiments, a nucleoside comprising a 2'-F is followed by an Rp chiral internucleotidic linkage. In some embodiments, a nucleoside comprising a 2'-modification is preceded by an Rp chiral internucleotidic linkage. In some embodiments, a nucleoside comprising a 2'-F is preceded by an Rp chiral internucleotidic linkage.

In some embodiments, oligonucleotides of the first plurality comprise one or more natural phosphate linkages and one or more modified internucleotidic linkages.

Provided oligonucleotides can comprise various number of natural phosphate linkages. In some embodiments, provided oligonucleotides comprise no natural phosphate linkages. In some embodiments, provided oligonucleotides comprise one natural phosphate linkage. In some embodiments, provided oligonucleotides comprise 2 or more natural phosphate linkages. In some embodiments, provided oligonucleotides comprise 3 or more natural phosphate linkages. In some embodiments, provided oligonucleotides comprise 4 or more natural phosphate linkages. In some embodiments, provided oligonucleotides comprise 5 or more natural phosphate linkages. In some embodiments, provided oligonucleotides comprise 6 or more natural phosphate linkages. In some embodiments, provided oligonucleotides comprise 7 or more natural phosphate linkages. In some embodiments, provided oligonucleotides comprise 8 or more natural phosphate linkages. In some embodiments, provided oligonucleotides comprise 9 or more natural phosphate linkages. In some embodiments, provided oligonucleotides comprise 10 or more natural phosphate linkages. In some embodiments, provided oligonucleotides comprise 15 or more natural phosphate linkages. In some embodiments, provided oligonucleotides comprise 20 or more natural phosphate linkages. In some embodiments, provided oligonucleotides comprise 25 or more natural phosphate linkages. In some embodiments, provided oligonucleotides comprise 30 or more natural phosphate linkages.

In some embodiments, 5% or more of the internucleotidic linkages of provided oligonucleotides are natural phosphate linkages. In some embodiments, 10% or more of the internucleotidic linkages of provided oligonucleotides are natural phosphate linkages. In some embodiments, 15% or more of the internucleotidic linkages of provided oligonucleotides are natural phosphate linkages. In some embodiments, 20% or more of the internucleotidic linkages of provided oligonucleotides are natural phosphate linkages. In some embodiments, 25% or more of the internucleotidic linkages of provided oligonucleotides are natural phosphate linkages. In some embodiments, 30% or more of the internucleotidic linkages of provided oligonucleotides are natural phosphate linkages. In some embodiments, 35% or more of the internucleotidic linkages of provided oligonucleotides are natural phosphate linkages. In some embodiments, 40% or more of the internucleotidic linkages of provided oligonucleotides are natural phosphate linkages. In some embodiments, 45% or more of the internucleotidic linkages of provided oligonucleotides are natural phosphate linkages. In some embodiments, 50% or more of the internucleotidic linkages of provided oligonucleotides are natural phosphate linkages. In some embodiments, 55% or more of the internucleotidic linkages of provided oligonucleotides are natural phosphate linkages. In some embodiments, 60% or more of the internucleotidic linkages of provided oligonucleotides are natural phosphate linkages. In some embodiments, 65% or more of the internucleotidic linkages of provided oligonucleotides are natural phosphate linkages. In some embodiments, 70% or more of the internucleotidic linkages of provided oligonucleotides are natural phosphate linkages. In some embodiments, 75% or more of the internucleotidic linkages of provided oligonucleotides are natural phosphate linkages. In some embodiments, 80% or more of the internucleotidic linkages of provided oligonucleotides are natural phosphate linkages. In some embodiments, 85% or more of the internucleotidic linkages of provided oligonucleotides are natural phosphate linkages. In some embodiments, 90% or more of the internucleotidic linkages of provided oligonucleotides are natural phosphate linkages. In some embodiments, 95% or more of the internucleotidic linkages of provided oligonucleotides are natural phosphate linkages.

Provided oligonucleotides can comprise various number of modified internucleotidic linkages. In some embodiments, provided oligonucleotides comprise one modified internucleotidic linkage. In some embodiments, provided oligonucleotides comprise 2 or more modified internucleotidic linkages. In some embodiments, provided oligonucleotides comprise 3 or more modified internucleotidic linkages. In some embodiments, provided oligonucleotides comprise 4 or more modified internucleotidic linkages. In some embodiments, provided oligonucleotides comprise 5 or more modified internucleotidic linkages. In some embodiments, provided oligonucleotides comprise 6 or more modified internucleotidic linkages. In some embodiments, provided oligonucleotides comprise 7 or more modified internucleotidic linkages. In some embodiments, provided oligonucleotides comprise 8 or more modified internucleotidic linkages. In some embodiments, provided oligonucleotides comprise 9 or more modified internucleotidic linkages. In some embodiments, provided oligonucleotides comprise 10 or more modified internucleotidic linkages. In some embodiments, provided oligonucleotides comprise 15 or more modified internucleotidic linkages. In some embodiments, provided oligonucleotides comprise 20 or more modified internucleotidic linkages. In some embodiments, provided oligonucleotides comprise 25 or more modified internucleotidic linkages. In some embodiments, provided oligonucleotides comprise 30 or more modified internucleotidic linkages.

In some embodiments, 5% or more of the internucleotidic linkages of provided oligonucleotides are modified internucleotidic linkages. In some embodiments, 10% or more of the internucleotidic linkages of provided oligonucleotides are modified internucleotidic linkages. In some embodiments, 15% or more of the internucleotidic linkages of provided oligonucleotides are modified internucleotidic linkages. In some embodiments, 20% or more of the internucleotidic linkages of provided oligonucleotides are modified internucleotidic linkages. In some embodiments, 25% or more of the internucleotidic linkages of provided oligonucleotides are modified internucleotidic linkages. In some embodiments, 30% or more of the internucleotidic linkages of provided oligonucleotides are modified internucleotidic linkages. In some embodiments, 35% or more of the internucleotidic linkages of provided oligonucleotides are modified internucleotidic linkages. In some embodiments, 40% or more of the internucleotidic linkages of provided oligonucleotides are modified internucleotidic linkages. In some embodiments, 45% or more of the internucleotidic linkages of provided oligonucleotides are modified internucleotidic linkages. In some embodiments, 50% or more of the internucleotidic linkages of provided oligonucleotides are modified internucleotidic linkages. In some embodiments, 55% or more of the internucleotidic linkages of provided oligonucleotides are modified internucleotidic linkages. In some embodiments, 60% or more of the internucleotidic linkages of provided oligonucleotides are modified internucleotidic linkages. In some embodiments, 65% or more of the internucleotidic linkages of provided oligonucleotides are modified internucleotidic linkages. In some embodiments, 70% or more of the internucleotidic linkages of provided oligonucleotides are modified internucleotidic linkages. In some embodiments, 75% or more of the internucleotidic linkages of provided oligonucleotides are modified internucleotidic linkages. In some embodiments, 80% or more of the internucleotidic linkages of provided oligonucleotides are modified internucleotidic linkages. In some embodiments, 85% or more of the internucleotidic linkages of provided oligonucleotides are modified internucleotidic linkages. In some embodiments, 90% or more of the internucleotidic linkages of provided oligonucleotides are modified internucleotidic linkages. In some embodiments, 95% or more of the internucleotidic linkages of provided oligonucleotides are modified internucleotidic linkages. In some embodiments, each internucleotidic linkage of provided oligonucleotides is a modified internucleotidic linkage.

In some embodiments, provided oligonucleotides comprise no more than about 25 consecutive unmodified sugar moieties. In some embodiments, provided oligonucleotides comprise no more than about 20 consecutive unmodified sugar moieties. In some embodiments, provided oligonucleotides comprise no more than about 15 consecutive unmodified sugar moieties. In some embodiments, provided oligonucleotides comprise no more than about 10 consecutive unmodified sugar moieties. In some embodiments, provided oligonucleotides comprise no more than about 9 consecutive unmodified sugar moieties. In some embodiments, provided oligonucleotides comprise no more than about 8 consecutive unmodified sugar moieties. In some embodiments, provided oligonucleotides comprise no more than about 7 consecutive unmodified sugar moieties. In some embodiments, provided oligonucleotides comprise no more than about 6 consecutive unmodified sugar moieties. In some embodiments, provided oligonucleotides comprise no more than about 5 consecutive unmodified sugar moieties. In some embodiments, provided oligonucleotides comprise no more than about 4 consecutive unmodified sugar moieties. In some embodiments, provided oligonucleotides comprise no more than about 3 consecutive unmodified sugar moieties. In some embodiments, provided oligonucleotides comprise no more than about 2 consecutive unmodified sugar moieties. In some embodiments, provided oligonucleotides comprise no more than about 25 unmodified sugar moieties. In some embodiments, provided oligonucleotides comprise no more than about 20 unmodified sugar moieties. In some embodiments, provided oligonucleotides comprise no more than about 15 unmodified sugar moieties. In some embodiments, provided oligonucleotides comprise no more than about 10 unmodified sugar moieties. In some embodiments, provided oligonucleotides comprise no more than about 5 unmodified sugar moieties.

In some embodiments, provided oligonucleotides comprise no more than about 95% unmodified sugar moieties. In some embodiments, provided oligonucleotides comprise no more than about 90% unmodified sugar moieties. In some embodiments, provided oligonucleotides comprise no more than about 85% unmodified sugar moieties. In some embodiments, provided oligonucleotides comprise no more than about 80% unmodified sugar moieties. In some embodiments, provided oligonucleotides comprise no more than about 70% unmodified sugar moieties. In some embodiments, provided oligonucleotides comprise no more than about 60% unmodified sugar moieties. In some embodiments, provided oligonucleotides comprise no more than about 50% unmodified sugar moieties. In some embodiments, provided oligonucleotides comprise no more than about 40% unmodified sugar moieties. In some embodiments, provided oligonucleotides comprise no more than about 30% unmodified sugar moieties. In some embodiments, provided oligonucleotides comprise no more than about 20% unmodified sugar moieties. In some embodiments, provided oligonucleotides comprise no more than about 10% unmodified sugar moieties. In some embodiments, provided oligonucleotides comprise no more than about 5% unmodified sugar moieties. In some embodiments, provided oligonucleotides comprise no more than about 15 consecutive unmodified sugar moieties. In some embodiments, provided oligonucleotides comprise no more than about 10 consecutive unmodified sugar moieties. In some embodiments, provided oligonucleotides comprise no more than about 9 consecutive unmodified sugar moieties. In some embodiments, provided oligonucleotides comprise no more than about 8 consecutive unmodified sugar moieties. In some embodiments, provided oligonucleotides comprise no more than about 7 consecutive unmodified sugar moieties. In some embodiments, provided oligonucleotides comprise no more than about 6 consecutive unmodified sugar moieties. In some embodiments, provided oligonucleotides comprise no more than about 5 consecutive unmodified sugar moieties. In some embodiments, provided oligonucleotides comprise no more than about 4 consecutive unmodified sugar moieties. In some embodiments, provided oligonucleotides comprise no more than about 3 consecutive unmodified sugar moieties. In some embodiments, provided oligonucleotides comprise no more than about 2 consecutive unmodified sugar moieties. In some embodiments, provided oligonucleotides comprise no more than about 25 unmodified sugar moieties. In some embodiments, provided oligonucleotides comprise no more than about 20 unmodified sugar moieties. In some embodiments, provided oligonucleotides comprise no more than about 15 unmodified sugar moieties. In some embodiments, provided oligonucleotides comprise no more than about 10 unmodified sugar moieties. In some embodiments, provided oligonucleotides comprise no more than about 5 unmodified sugar moieties.

In some embodiments, provided oligonucleotides comprise no more than about 95% unmodified sugar moieties. In some embodiments, provided oligonucleotides comprise no more than about 90% unmodified sugar moieties. In some embodiments, provided oligonucleotides comprise no more than about 85% unmodified sugar moieties. In some embodiments, provided oligonucleotides comprise no more than about 80% unmodified sugar moieties. In some embodiments, provided oligonucleotides comprise no more than about 70% unmodified sugar moieties. In some embodiments, provided oligonucleotides comprise no more than about 60% unmodified sugar moieties. In some embodiments, provided oligonucleotides comprise no more than about 50% unmodified sugar moieties. In some embodiments, provided oligonucleotides comprise no more than about 40% unmodified sugar moieties. In some embodiments, provided oligonucleotides comprise no more than about 30% unmodified sugar moieties. In some embodiments, provided oligonucleotides comprise no more than about 20% unmodified sugar moieties. In some embodiments, provided oligonucleotides comprise no more than about 10% unmodified sugar moieties. In some embodiments, provided oligonucleotides comprise no more than about 5% unmodified sugar moieties. In some embodiments, each sugar moiety of the oligonucleotides of the first plurality is independently modified.

In some embodiments, provided compositions alter transcript splicing so that an undesired target and/or biological function are suppressed. In some embodiments, in such cases provided composition can also induce cleavage of the transcript after hybridization.

In some embodiments, provided compositions alter transcript splicing so a desired target and/or biological function is enhanced. In some embodiments, provided compositions, by incorporating chemical modifications, stereochemistry and/or combinations thereof, effectively suppress or prevent cleavage of a target transcript after contact.

In some embodiments, each oligonucleotide of the first plurality comprises one or more modified sugar moieties and modified internucleotidic linkages. In some embodiments, each oligonucleotide of the first plurality comprises two or more modified sugar moieties. In some embodiments, each oligonucleotide of the first plurality comprises three or more modified sugar moieties. In some embodiments, each oligonucleotide of the first plurality comprises four or more modified sugar moieties. In some embodiments, each oligonucleotide of the first plurality comprises five or more modified sugar moieties. In some embodiments, each oligonucleotide of the first plurality comprises ten or more modified sugar moieties. In some embodiments, each oligonucleotide of the first plurality comprises about 15 or more modified sugar moieties. In some embodiments, each oligonucleotide of the first plurality comprises about 20 or more modified sugar moieties. In some embodiments, each oligonucleotide of the first plurality comprises about 25 or more modified sugar moieties.

In some embodiments, about 5% of the sugar moieties in each oligonucleotide of the first plurality are modified sugar moieties. In some embodiments, about 10% or more of the sugar moieties in each oligonucleotide of the first plurality are modified sugar moieties. In some embodiments, about 20% or more of the sugar moieties in each oligonucleotide of the first plurality are modified sugar moieties. In some embodiments, about 30% or more of the sugar moieties in each oligonucleotide of the first plurality are modified sugar moieties. In some embodiments, about 40% or more of the sugar moieties in each oligonucleotide of the first plurality are modified sugar moieties. In some embodiments, about 50% or more of the sugar moieties in each oligonucleotide of the first plurality are modified sugar moieties. In some embodiments, about 60% or more of the sugar moieties in each oligonucleotide of the first plurality are modified sugar moieties. In some embodiments, about 70% or more of the sugar moieties in each oligonucleotide of the first plurality are modified sugar moieties. In some embodiments, about 80% or more of the sugar moieties in each oligonucleotide of the first plurality are modified sugar moieties. In some embodiments, about 85% or more of the sugar moieties in each oligonucleotide of the first plurality are modified sugar moieties. In some embodiments, about 90% or more of the sugar moieties in each oligonucleotide of the first plurality are modified sugar moieties. In some embodiments, about 95% or more of the sugar moieties in each oligonucleotide of the first plurality are modified sugar moieties.

In some embodiments, each oligonucleotide of the first plurality comprises no more than about 25 consecutive unmodified sugar moieties. In some embodiments, each oligonucleotide of the first plurality comprises no more than about 20 consecutive unmodified sugar moieties. In some embodiments, each oligonucleotide of the first plurality comprises no more than about 15 consecutive unmodified sugar moieties. In some embodiments, each oligonucleotide of the first plurality comprises no more than about 10 consecutive unmodified sugar moieties. In some embodiments, each oligonucleotide of the first plurality comprises no more than about 9 consecutive unmodified sugar moieties. In some embodiments, each oligonucleotide of the first plurality comprises no more than about 8 consecutive unmodified sugar moieties. In some embodiments, each oligonucleotide of the first plurality comprises no more than about 7 consecutive unmodified sugar moieties. In some embodiments, each oligonucleotide of the first plurality comprises no more than about 6 consecutive unmodified sugar moieties. In some embodiments, each oligonucleotide of the first plurality comprises no more than about 5 consecutive unmodified sugar moieties. In some embodiments, each oligonucleotide of the first plurality comprises no more than about 4 consecutive unmodified sugar moieties. In some embodiments, each oligonucleotide of the first plurality comprises no more than about 3 consecutive unmodified sugar moieties. In some embodiments, each oligonucleotide of the first plurality comprises no more than about 2 consecutive unmodified sugar moieties. In some embodiments, each oligonucleotide of the first plurality comprises no more than about 25 unmodified sugar moieties. In some embodiments, each oligonucleotide of the first plurality comprises no more than about 20 unmodified sugar moieties. In some embodiments, each oligonucleotide of the first plurality comprises no more than about 15 unmodified sugar moieties. In some embodiments, each oligonucleotide of the first plurality comprises no more than about 10 unmodified sugar moieties. In some embodiments, each oligonucleotide of the first plurality comprises no more than about 5 unmodified sugar moieties.

In some embodiments, each oligonucleotide of the first plurality comprises no more than about 95% unmodified sugar moieties. In some embodiments, each oligonucleotide of the first plurality comprises no more than about 90% unmodified sugar moieties. In some embodiments, each oligonucleotide of the first plurality comprises no more than about 85% unmodified sugar moieties. In some embodiments, each oligonucleotide of the first plurality comprises no more than about 80% unmodified sugar moieties. In some embodiments, each oligonucleotide of the first plurality comprises no more than about 70% unmodified sugar moieties. In some embodiments, each oligonucleotide of the first plurality comprises no more than about 60% unmodified sugar moieties. In some embodiments, each oligonucleotide of the first plurality comprises no more than about 50% unmodified sugar moieties. In some embodiments, each oligonucleotide of the first plurality comprises no more than about 40% unmodified sugar moieties. In some embodiments, each oligonucleotide of the first plurality comprises no more than about 30% unmodified sugar moieties. In some embodiments, each oligonucleotide of the first plurality comprises no more than about 20% unmodified sugar moieties. In some embodiments, each oligonucleotide of the first plurality comprises no more than about 10% unmodified sugar moieties. In some embodiments, each oligonucleotide of the first plurality comprises no more than about 5% unmodified sugar moieties. In some embodiments, each oligonucleotide of the first plurality comprises no more than about 15 consecutive unmodified sugar moieties. In some embodiments, each oligonucleotide of the first plurality comprises no more than about 10 consecutive unmodified sugar moieties. In some embodiments, each oligonucleotide of the first plurality comprises no more than about 9 consecutive unmodified sugar moieties. In some embodiments, each oligonucleotide of the first plurality comprises no more than about 8 consecutive unmodified sugar moieties. In some embodiments, each oligonucleotide of the first plurality comprises no more than about 7 consecutive unmodified sugar moieties. In some embodiments, each oligonucleotide of the first plurality comprises no more than about 6 consecutive unmodified sugar moieties. In some embodiments, each oligonucleotide of the first plurality comprises no more than about 5 consecutive unmodified sugar moieties. In some embodiments, each oligonucleotide of the first plurality comprises no more than about 4 consecutive unmodified sugar moieties. In some embodiments, each oligonucleotide of the first plurality comprises no more than about 3 consecutive unmodified sugar moieties. In some embodiments, each oligonucleotide of the first plurality comprises no more than about 2 consecutive unmodified sugar moieties. In some embodiments, each oligonucleotide of the first plurality comprises no more than about 25 unmodified sugar moieties. In some embodiments, each oligonucleotide of the first plurality comprises no more than about 20 unmodified sugar moieties. In some embodiments, each oligonucleotide of the first plurality comprises no more than about 15 unmodified sugar moieties. In some embodiments, each oligonucleotide of the first plurality comprises no more than about 10 unmodified sugar moieties. In some embodiments, each oligonucleotide of the first plurality comprises no more than about 5 unmodified sugar moieties.

In some embodiments, each oligonucleotide of the first plurality comprises no more than about 95% unmodified sugar moieties. In some embodiments, each oligonucleotide of the first plurality comprises no more than about 90% unmodified sugar moieties. In some embodiments, each oligonucleotide of the first plurality comprises no more than about 85% unmodified sugar moieties. In some embodiments, each oligonucleotide of the first plurality comprises no more than about 80% unmodified sugar moieties. In some embodiments, each oligonucleotide of the first plurality comprises no more than about 70% unmodified sugar moieties. In some embodiments, each oligonucleotide of the first plurality comprises no more than about 60% unmodified sugar moieties. In some embodiments, each oligonucleotide of the first plurality comprises no more than about 50% unmodified sugar moieties. In some embodiments, each oligonucleotide of the first plurality comprises no more than about 40% unmodified sugar moieties. In some embodiments, each oligonucleotide of the first plurality comprises no more than about 30% unmodified sugar moieties. In some embodiments, each oligonucleotide of the first plurality comprises no more than about 20% unmodified sugar moieties. In some embodiments, each oligonucleotide of the first plurality comprises no more than about 10% unmodified sugar moieties. In some embodiments, each oligonucleotide of the first plurality comprises no more than about 5% unmodified sugar moieties. In some embodiments, each sugar moiety of the oligonucleotides of the first plurality is independently modified.

In some embodiments, each oligonucleotide of the first plurality comprises two or more modified internucleotidic linkages. In some embodiments, each oligonucleotide of the first plurality comprises three or more modified internucleotidic linkages. In some embodiments, each oligonucleotide of the first plurality comprises four or more modified internucleotidic linkages. In some embodiments, each oligonucleotide of the first plurality comprises five or more modified internucleotidic linkages. In some embodiments, each oligonucleotide of the first plurality comprises ten or more modified internucleotidic linkages. In some embodiments, each oligonucleotide of the first plurality comprises about 15 or more modified internucleotidic linkages. In some embodiments, each oligonucleotide of the first plurality comprises about 20 or more modified internucleotidic linkages. In some embodiments, each oligonucleotide of the first plurality comprises about 25 or more modified internucleotidic linkages.

In some embodiments, about 5% of the internucleotidic linkages in each oligonucleotide of the first plurality are modified internucleotidic linkages. In some embodiments, about 10% of the internucleotidic linkages in each oligonucleotide of the first plurality are modified internucleotidic linkages. In some embodiments, about 20% of the internucleotidic linkages in each oligonucleotide of the first plurality are modified internucleotidic linkages. In some embodiments, about 30% of the internucleotidic linkages in each oligonucleotide of the first plurality are modified internucleotidic linkages. In some embodiments, about 40% of the internucleotidic linkages in each oligonucleotide of the first plurality are modified internucleotidic linkages. In some embodiments, about 50% of the internucleotidic linkages in each oligonucleotide of the first plurality are modified internucleotidic linkages. In some embodiments, about 60% of the internucleotidic linkages in each oligonucleotide of the first plurality are modified internucleotidic linkages. In some embodiments, about 70% of the internucleotidic linkages in each oligonucleotide of the first plurality are modified internucleotidic linkages. In some embodiments, about 80% of the internucleotidic linkages in each oligonucleotide of the first plurality are modified internucleotidic linkages. In some embodiments, about 85% of the internucleotidic linkages in each oligonucleotide of the first plurality are modified internucleotidic linkages. In some embodiments, about 90% of the internucleotidic linkages in each oligonucleotide of the first plurality are modified internucleotidic linkages. In some embodiments, about 95% of the internucleotidic linkages in each oligonucleotide of the first plurality are modified internucleotidic linkages.

In some embodiments, each oligonucleotide of the first plurality comprises no more than about 25 consecutive natural phosphate linkages. In some embodiments, each oligonucleotide of the first plurality comprises no more than about 20 consecutive natural phosphate linkages. In some embodiments, each oligonucleotide of the first plurality comprises no more than about 15 consecutive natural phosphate linkages. In some embodiments, each oligonucleotide of the first plurality comprises no more than about 10 consecutive natural phosphate linkages. In some embodiments, each oligonucleotide of the first plurality comprises no more than about 9 consecutive natural phosphate linkages. In some embodiments, each oligonucleotide of the first plurality comprises no more than about 8 consecutive natural phosphate linkages. In some embodiments, each oligonucleotide of the first plurality comprises no more than about 7 consecutive natural phosphate linkages. In some embodiments, each oligonucleotide of the first plurality comprises no more than about 6 consecutive natural phosphate linkages. In some embodiments, each oligonucleotide of the first plurality comprises no more than about 5 consecutive natural phosphate linkages. In some embodiments, each oligonucleotide of the first plurality comprises no more than about 4 consecutive natural phosphate linkages. In some embodiments, each oligonucleotide of the first plurality comprises no more than about 3 consecutive natural phosphate linkages. In some embodiments, each oligonucleotide of the first plurality comprises no more than about 2 consecutive natural phosphate linkages. In some embodiments, each oligonucleotide of the first plurality comprises no more than about 25 natural phosphate linkages. In some embodiments, each oligonucleotide of the first plurality comprises no more than about 20 natural phosphate linkages. In some embodiments, each oligonucleotide of the first plurality comprises no more than about 15 natural phosphate linkages. In some embodiments, each oligonucleotide of the first plurality comprises no more than about 10 natural phosphate linkages. In some embodiments, each oligonucleotide of the first plurality comprises no more than about 5 natural phosphate linkages. In some embodiments, each oligonucleotide of the first plurality comprises no more than about 95% natural phosphate linkages. In some embodiments, each oligonucleotide of the first plurality comprises no more than about 90% natural phosphate linkages. In some embodiments, each oligonucleotide of the first plurality comprises no more than about 85% natural phosphate linkages. In some embodiments, each oligonucleotide of the first plurality comprises no more than about 80% natural phosphate linkages. In some embodiments, each oligonucleotide of the first plurality comprises no more than about 70% natural phosphate linkages. In some embodiments, each oligonucleotide of the first plurality comprises no more than about 60% natural phosphate linkages. In some embodiments, each oligonucleotide of the first plurality comprises no more than about 50% natural phosphate linkages. In some embodiments, each oligonucleotide of the first plurality comprises no more than about 40% natural phosphate linkages. In some embodiments, each oligonucleotide of the first plurality comprises no more than about 30% natural phosphate linkages. In some embodiments, each oligonucleotide of the first plurality comprises no more than about 20% natural phosphate linkages. In some embodiments, each oligonucleotide of the first plurality comprises no more than about 10% natural phosphate linkages. In some embodiments, each oligonucleotide of the first plurality comprises no more than about 5% natural phosphate linkages.

In some embodiments, oligonucleotides of the first plurality comprise no DNA nucleotide. A DNA nucleotide is a nucleotide in which the sugar moiety is an unmodified DNA sugar moiety, and the internucleotidic linkage is a natural phosphate linkage. In some embodiments, oligonucleotides of the first plurality comprise no more than 2 DNA nucleotides. In some embodiments, oligonucleotides of the first plurality comprise no more than 3 DNA nucleotides. In some embodiments, oligonucleotides of the first plurality comprise no more than 4 DNA nucleotides. In some embodiments, oligonucleotides of the first plurality comprise no more than 5 DNA nucleotides. In some embodiments, oligonucleotides of the first plurality comprise no more than 6 DNA nucleotides. In some embodiments, oligonucleotides of the first plurality comprise no more than 7 DNA nucleotides. In some embodiments, oligonucleotides of the first plurality comprise no more than 8 DNA nucleotides. In some embodiments, oligonucleotides of the first plurality comprise no more than 9 DNA nucleotides. In some embodiments, oligonucleotides of the first plurality comprise no more than 10 DNA nucleotides. In some embodiments, oligonucleotides of the first plurality comprise no more than 11 DNA nucleotides. In some embodiments, oligonucleotides of the first plurality comprise no more than 12 DNA nucleotides. In some embodiments, oligonucleotides of the first plurality comprise no more than 13 DNA nucleotides. In some embodiments, oligonucleotides of the first plurality comprise no more than 14 DNA nucleotides. In some embodiments, oligonucleotides of the first plurality comprise no more than 15 DNA nucleotides. In some embodiments, oligonucleotides of the first plurality comprise no more than 20 DNA nucleotides. In some embodiments, oligonucleotides of the first plurality comprise no more than 25 DNA nucleotides. In some embodiments, oligonucleotides of the first plurality comprise no more than 30 DNA nucleotides.

In some embodiments, oligonucleotides of the first plurality comprise no more than 2 consecutive DNA nucleotides. In some embodiments, oligonucleotides of the first plurality comprise no more than 3 consecutive DNA nucleotides. In some embodiments, oligonucleotides of the first plurality comprise no more than 4 consecutive DNA nucleotides. In some embodiments, oligonucleotides of the first plurality comprise no more than 5 consecutive DNA nucleotides. In some embodiments, oligonucleotides of the first plurality comprise no more than 6 consecutive DNA nucleotides. In some embodiments, oligonucleotides of the first plurality comprise no more than 7 consecutive DNA nucleotides. In some embodiments, oligonucleotides of the first plurality comprise no more than 8 consecutive DNA nucleotides. In some embodiments, oligonucleotides of the first plurality comprise no more than 9 consecutive DNA nucleotides. In some embodiments, oligonucleotides of the first plurality comprise no more than 10 consecutive DNA nucleotides. In some embodiments, oligonucleotides of the first plurality comprise no more than 11 consecutive DNA nucleotides. In some embodiments, oligonucleotides of the first plurality comprise no more than 12 consecutive DNA nucleotides. In some embodiments, oligonucleotides of the first plurality comprise no more than 13 consecutive DNA nucleotides. In some embodiments, oligonucleotides of the first plurality comprise no more than 14 consecutive DNA nucleotides. In some embodiments, oligonucleotides of the first plurality comprise no more than 15 consecutive DNA nucleotides. In some embodiments, oligonucleotides of the first plurality comprise no more than 20 consecutive DNA nucleotides. In some embodiments, oligonucleotides of the first plurality comprise no more than 25 consecutive DNA nucleotides. In some embodiments, oligonucleotides of the first plurality comprise no more than 30 consecutive DNA nucleotides.

In some embodiments, compared to a reference condition, provided chirally controlled oligonucleotide compositions are surprisingly effective. In some embodiments, desired biological effects (e.g., as measured by increased levels of desired mRNA, proteins, etc., decreased levels of undesired mRNA, proteins, etc.) can be enhanced by more than 5, 10, 15, 20, 25, 30, 40, 50, or 100 fold. In some embodiments, a change is measured by increase of a desired mRNA level compared to a reference condition. In some embodiments, a change is measured by decrease of an undesired mRNA level compared to a reference condition. In some embodiments, a reference condition is absence of oligonucleotide treatment. In some embodiments, a reference condition is a stereorandom composition of oligonucleotides having the same base sequence and chemical modifications.

In some embodiments, a desired biological effect is enhanced by more than 2 fold. In some embodiments, a desired biological effect is enhanced by more than 3 fold. In some embodiments, a desired biological effect is enhanced by more than 4 fold. In some embodiments, a desired biological effect is enhanced by more than 5 fold. In some embodiments, a desired biological effect is enhanced by more than 6 fold. In some embodiments, a desired biological effect is enhanced by more than 7 fold. In some embodiments, a desired biological effect is enhanced by more than 8 fold. In some embodiments, a desired biological effect is enhanced by more than 9 fold. In some embodiments, a desired biological effect is enhanced by more than 10 fold. In some embodiments, a desired biological effect is enhanced by more than 11 fold. In some embodiments, a desired biological effect is enhanced by more than 12 fold. In some embodiments, a desired biological effect is enhanced by more than 13 fold. In some embodiments, a desired biological effect is enhanced by more than 14 fold. In some embodiments, a desired biological effect is enhanced by more than 15 fold. In some embodiments, a desired biological effect is enhanced by more than 20 fold. In some embodiments, a desired biological effect is enhanced by more than 25 fold. In some embodiments, a desired biological effect is enhanced by more than 30 fold. In some embodiments, a desired biological effect is enhanced by more than 35 fold. In some embodiments, a desired biological effect is enhanced by more than 40 fold. In some embodiments, a desired biological effect is enhanced by more than 45 fold. In some embodiments, a desired biological effect is enhanced by more than 50 fold. In some embodiments, a desired biological effect is enhanced by more than 60 fold. In some embodiments, a desired biological effect is enhanced by more than 70 fold. In some embodiments, a desired biological effect is enhanced by more than 80 fold. In some embodiments, a desired biological effect is enhanced by more than 90 fold. In some embodiments, a desired biological effect is enhanced by more than 100 fold. In some embodiments, a desired biological effect is enhanced by more than 200 fold. In some embodiments, a desired biological effect is enhanced by more than 500 fold.

In some embodiments, provided oligonucleotides comprise two wing regions and one core regions. In some embodiments, provided oligonucleotides comprises a 5'-wing-core-wing-3' structure. In some embodiments, provided oligonucleotides are of a 5'-wing-core-wing-3' gapmer structure. In some embodiments, the two wing regions are identical. In some embodiments, the two wing regions are different. In some embodiments, the two wing regions are identical in chemical modifications. In some embodiments, the two wing regions are identical in 2'-modifications. In some embodiments, the two wing regions are identical in internucleotidic linkage modifications. In some embodiments, the two regions are identical in patterns of backbone chiral centers. In some embodiments, the two wing regions are identical in pattern of backbone linkages. In some embodiments, the two wing regions are identical in pattern of backbone linkage types. In some embodiments, the two wing regions are identical in pattern of backbone phosphorus modifications.

In some embodiments, provided oligonucleotides comprise one wing and one core regions. In some embodiments, provided oligonucleotides comprises a 5'-wing-core-3' hemimer structure. In some embodiments, provided oligonucleotides are of a 5'-wing-core-3' hemimer structure. In some embodiments, provided oligonucleotides comprises a 5'-core-wing-3' hemimer structure. In some embodiments, provided oligonucleotides are of a 5'-core-wing-3' hemimer structure.

A wing region can be differentiated from a core region in that a wing region contains a different structure feature than a core region. For example, in some embodiments, a wing region differs from a core region in that they have different sugar modifications, base modifications, internucleotidic linkages, internucleotidic linkage stereochemistry, etc. In some embodiments, a wing region differs from a core region in that they have different 2'-modifications of the sugars.

In some embodiments, an internucleotidic linkage between a wing region and a core region is considered part of the wing region. In some embodiments, an internucleotidic linkage between a 5'-wing region and a core region is considered part of the wing region. In some embodiments, an internucleotidic linkage between a 3'-wing region and a core region is considered part of the wing region. In some embodiments, an internucleotidic linkage between a wing region and a core region is considered part of the core region. In some embodiments, an internucleotidic linkage between a 5'-wing region and a core region is considered part of the core region. In some embodiments, an internucleotidic linkage between a 3'-wing region and a core region is considered part of the core region.

In some embodiments, an internucleotidic linkage between a wing region and a core region is considered part of the wing region. In some embodiments, an internucleotidic linkage between a 5'-wing region and a core region is considered part of the wing region. In some embodiments, an internucleotidic linkage between a 3'-wing region and a core region is considered part of the wing region. In some embodiments, an internucleotidic linkage between a wing region and a core region is considered part of the core region. In some embodiments, an internucleotidic linkage between a 5'-wing region and a core region is considered part of the core region. In some embodiments, an internucleotidic linkage between a 3'-wing region and a core region is considered part of the core region.

In some embodiments, a wing region comprises 2 or more nucleosides. In some embodiments, a wing region comprises 3 or more nucleosides. In some embodiments, a wing region comprises 4 or more nucleosides. In some embodiments, a wing region comprises 5 or more nucleosides. In some embodiments, a wing region comprises 6 or more nucleosides. In some embodiments, a wing region comprises 7 or more nucleosides. In some embodiments, a wing region comprises 8 or more nucleosides. In some embodiments, a wing region comprises 9 or more nucleosides. In some embodiments, a wing region comprises 10 or more nucleosides. In some embodiments, a wing region comprises 11 or more nucleosides. In some embodiments, a wing region comprises 12 or more nucleosides. In some embodiments, a wing region comprises 13 or more nucleosides. In some embodiments, a wing region comprises 14 or more nucleosides. In some embodiments, a wing region comprises 15 or more nucleosides.

In some embodiments, provided oligonucleotides comprise two wing and one core regions. In some embodiments, provided oligonucleotides comprises a 5'-wing-core-wing-3' structure. In some embodiments, provided oligonucleotides are of a 5'-wing-core-wing-3' gapmer structure. In some embodiments, the two wing regions are identical. In some embodiments, the two wing regions are different. In some embodiments, the two wing regions are identical in chemical modifications. In some embodiments, the two wing regions are identical in 2'-modifications. In some embodiments, the two wing regions are identical in internucleotidic linkage modifications. In some embodiments, the two wing regions are identical in patterns of backbone chiral centers. In some embodiments, the two wing regions are identical in pattern of backbone linkages. In some embodiments, the two wing regions are identical in pattern of backbone linkage types. In some embodiments, the two wing regions are identical in pattern of backbone phosphorus modifications.

In some embodiments, provided oligonucleotides comprise one wing and one core regions. In some embodiments, provided oligonucleotides comprises a 5'-wing-core-3' hemimer structure. In some embodiments, provided oligonucleotides are of a 5'-wing-core-3' hemimer structure. In some embodiments, provided oligonucleotides comprises a 5'-core-wing-3' hemimer structure. In some embodiments, provided oligonucleotides are of a 5'-core-wing-3' hemimer structure.

A wing region can be differentiated from a core region in that a wing region contains a different structure feature than a core region. For example, in some embodiments, a wing region differs from a core region in that they have different sugar modifications, base modifications, internucleotidic linkages, internucleotidic linkage stereochemistry, etc. In some embodiments, a wing region differs from a core region in that they have different 2'-modifications of the sugars.

In some embodiments, an internucleotidic linkage between a wing region and a core region is considered part of the wing region. In some embodiments, an internucleotidic linkage between a 5'-wing region and a core region is considered part of the wing region. In some embodiments, an internucleotidic linkage between a 3'-wing region and a core region is considered part of the wing region. In some embodiments, an internucleotidic linkage between a wing region and a core region is considered part of the core region. In some embodiments, an internucleotidic linkage between a 5'-wing region and a core region is considered part of the core region. In some embodiments, an internucleotidic linkage between a 3'-wing region and a core region is considered part of the core region.

In some embodiments, an internucleotidic linkage between a wing region and a core region is considered part of the wing region. In some embodiments, an internucleotidic linkage between a 5'-wing region and a core region is considered part of the wing region. In some embodiments, an internucleotidic linkage between a 3'-wing region and a core region is considered part of the wing region. In some embodiments, an internucleotidic linkage between a wing region and a core region is considered part of the core region. In some embodiments, an internucleotidic linkage between a 5'-wing region and a core region is considered part of the core region. In some embodiments, an internucleotidic linkage between a 3'-wing region and a core region is considered part of the core region.

In some embodiments, a wing region comprises 2 or more nucleosides. In some embodiments, a wing region comprises 3 or more nucleosides. In some embodiments, a wing region comprises 4 or more nucleosides. In some embodiments, a wing region comprises 5 or more nucleosides. In some embodiments, a wing region comprises 6 or more nucleosides. In some embodiments, a wing region comprises 7 or more nucleosides. In some embodiments, a wing region comprises 8 or more nucleosides. In some embodiments, a wing region comprises 9 or more nucleosides. In some embodiments, a wing region comprises 10 or more nucleosides. In some embodiments, a wing region comprises 11 or more nucleosides. In some embodiments, a wing region comprises 12 or more nucleosides. In some embodiments, a wing region comprises 13 or more nucleosides. In some embodiments, a wing region comprises 14 or more nucleosides. In some embodiments, a wing region comprises 15 or more nucleosides.

In some embodiments, a wing region comprises 2 or more modified internucleotidic linkages. In some embodiments, a wing region comprises 3 or more modified internucleotidic linkages. In some embodiments, a wing region comprises 4 or more modified internucleotidic linkages. In some embodiments, a wing region comprises 5 or more modified internucleotidic linkages. In some embodiments, a wing region comprises 6 or more modified internucleotidic linkages. In some embodiments, a wing region comprises 7 or more modified internucleotidic linkages. In some embodiments, a wing region comprises 8 or more modified internucleotidic linkages. In some embodiments, a wing region comprises 9 or more modified internucleotidic linkages. In some embodiments, a wing region comprises 10 or more modified internucleotidic linkages. In some embodiments, a wing region comprises 11 or more modified internucleotidic linkages. In some embodiments, a wing region comprises 12 or more modified internucleotidic linkages. In some embodiments, a wing region comprises 13 or more modified internucleotidic linkages. In some embodiments, a wing region comprises 14 or more modified internucleotidic linkages. In some embodiments, a wing region comprises 15 or more modified internucleotidic linkages.

In some embodiments, the present disclosure provides an oligonucleotide composition comprising a first plurality of oligonucleotides which: 1) have a common base sequence complementary to a target sequence in a transcript; and 2) comprise one or more modified sugar moieties and modified internucleotidic linkages.

In some embodiments, a provided oligonucleotide composition is characterized in that, when it is contacted with the transcript in a transcript splicing system, splicing of the transcript is altered relative to that observed under reference conditions selected from the group consisting of absence of the composition, presence of a reference composition, and combinations thereof.

In some embodiments, the present disclosure provides an oligonucleotide composition comprising a first plurality of oligonucleotides of a particular oligonucleotide type defined by:

1) base sequence;
2) pattern of backbone linkages;
3) pattern of backbone chiral centers; and
4) pattern of backbone phosphorus modifications, which composition is chirally controlled in that it is enriched, relative to a substantially racemic preparation of oligonucleotides having the same base sequence, for oligonucleotides of the particular oligonucleotide type, the oligonucleotide composition being characterized in that, when it is contacted with the transcript in a transcript splicing system, splicing of the transcript is altered relative to that observed under reference conditions selected from the group consisting of absence of the composition, presence of a reference composition, and combinations thereof.

In some embodiments, the present disclosure provides an oligonucleotide composition comprising a first plurality of oligonucleotides comprising one or more wing regions and a core region, wherein:

oligonucleotides of the first plurality have the same base sequence; and each wing region independently comprises one or more modified internucleotidic linkages and optionally one or more natural phosphate linkages, and the core region independently comprises one or more modified internucleotidic linkages; or each wing region independently comprises one or more modified sugar moieties, and the core region comprises one or more un-modified sugar moieties.

In some embodiments, the present disclosure provides an oligonucleotide composition comprising a first plurality of oligonucleotides comprising one or more wing regions and a core region, wherein:

oligonucleotides of the first plurality have the same base sequence; and each wing region independently comprises one or more modified internucleotidic linkages and optionally one or more natural phosphate linkages, and the core region independently comprises one or more modified internucleotidic linkages.

In some embodiments, the present disclosure provides an oligonucleotide composition comprising a first plurality of oligonucleotides comprising one or more wing regions and a core region, wherein:

oligonucleotides of the first plurality have the same base sequence; and each wing region independently comprises one or more modified sugar moieties, and the core region comprises one or more un-modified sugar moieties.

In some embodiments, the present disclosure provides an oligonucleotide composition comprising a first plurality of oligonucleotides comprising one or more wing regions and a core region, wherein:

oligonucleotides of the first plurality have the same base sequence; and each wing region independently comprises one or more modified internucleotidic linkages and optionally one or more natural phosphate linkages, and the core region independently comprises one or more modified internucleotidic linkages; and each wing region independently comprises one or more modified sugar moieties, and the core region comprises one or more un-modified sugar moieties.

In some embodiments, the present disclosure provides an oligonucleotide composition comprising a first plurality of oligonucleotides comprising one or more wing regions and a core region, wherein:

oligonucleotides of the first plurality have the same base sequence; and each wing region independently comprises one or more modified internucleotidic linkages and one or more natural phosphate linkages, and the core region independently comprises one or more modified internucleotidic linkages; and each wing region independently comprises one or more modified sugar moieties, and the core region comprises one or more un-modified sugar moieties.

In some embodiments, the present disclosure provides an oligonucleotide composition comprising a first plurality of oligonucleotides comprising one or more wing regions and a core region, wherein:

oligonucleotides of the first plurality have the same base sequence;

each wing region independently has a length of two or more bases, and independently comprises one or more modified internucleotidic linkages and optionally one or more natural phosphate linkages; and the core region independently has a length of two or more bases and independently comprises one or more modified internucleotidic linkages.

In some embodiments, the present disclosure provides an oligonucleotide composition comprising a first plurality of oligonucleotides comprising one or more wing regions and a core region, wherein:

oligonucleotides of the first plurality have the same base sequence;

each wing region independently has a length of two or more bases, and independently comprises one or more modified internucleotidic linkages and one or more natural phosphate linkages; and the core region independently has a length of two or more bases and independently comprises one or more modified internucleotidic linkages.

In some embodiments, the present disclosure provides an oligonucleotide composition comprising a first plurality of oligonucleotides comprising two wing regions and a core region, wherein:

oligonucleotides of the first plurality have the same base sequence;

each wing region independently has a length of two or more bases, and independently comprises one or more modified internucleotidic linkages and one or more natural phosphate linkages; and the core region independently has a length of two or more bases and independently comprises one or more modified internucleotidic linkages.

In some embodiments, the present disclosure provides an oligonucleotide composition comprising a first plurality of oligonucleotides comprising two wing regions and a core region, wherein:

oligonucleotides of the first plurality have the same base sequence;

each wing region independently has a length of two or more bases, and independently comprises one or more modified internucleotidic linkages and one or more natural phosphate linkages;

the wing region to the 5'-end of the core region comprises at least one modified internucleotidic linkage followed by a natural phosphate linkage in the wing; and the wing region to the 3'-end of the core region comprises at least one modified internucleotidic linkage preceded by a natural phosphate linkage in the wing;

the core region independently has a length of two or more bases and independently comprises one or more modified internucleotidic linkages.

In some embodiments, the present disclosure provides an oligonucleotide composition comprising a first plurality of oligonucleotides comprising a wing region and a core region, wherein:

oligonucleotides of the first plurality have the same base sequence;

the wing region has a length of two or more bases, and comprises one or more modified internucleotidic linkages and one or more natural phosphate linkages;

the wing region is to the 5'-end of the core region and comprises a modified internucleotidic linkage between the two nucleosides at its 3'-end, or the wing region to the 3'-end of the core region and comprises a modified internucleotidic linkage between the two nucleosides at its 5'-end; and the core region independently has a length of two or more bases and independently comprises one or more modified internucleotidic linkages.

In some embodiments, the present disclosure provides an oligonucleotide composition comprising a first plurality of oligonucleotides comprising two wing regions and a core region, wherein:

oligonucleotides of the first plurality have the same base sequence;

each wing region independently has a length of two or more bases, and independently comprises one or more modified internucleotidic linkages and one or more natural phosphate linkages;

the wing region to the 5'-end of the core region comprises a modified internucleotidic linkage between the two nucleosides at its 3'-end;

the wing region to the 3'-end of a core region comprises a modified internucleotidic linkage between the two nucleosides at its 5'-end; and the core region independently has a length of two or more bases and independently comprises one or more modified internucleotidic linkages.

In some embodiments, the present disclosure provides an oligonucleotide composition comprising a first plurality of oligonucleotides, wherein:

oligonucleotides of the first plurality have the same base sequence;

oligonucleotides of the first plurality comprise 2, 3, 4, 5, 6, 7, 8, 9, 10, 11, 12, 13, 14, 15, 16, 17, 18, 19, 20 or more nucleoside units comprising —F.

In some embodiments, the present disclosure provides an oligonucleotide composition comprising a first plurality of oligonucleotides, wherein:

oligonucleotides of the first plurality have the same base sequence;

oligonucleotides of the first plurality comprise 2, 3, 4, 5, 6, 7, 8, 9, 10, 11, 12, 13, 14, 15, 16, 17, 18, 19, 20 or more consecutive nucleoside units comprising —F.

In some embodiments, the present disclosure provides an oligonucleotide composition comprising a first plurality of oligonucleotides, wherein:

oligonucleotides of the first plurality have the same base sequence;

oligonucleotides of the first plurality comprise 2, 3, 4, 5, 6, 7, 8, 9, 10, 11, 12, 13, 14, 15, 16, 17, 18, 19, 20 or more consecutive nucleoside units comprising 2'-F modified sugar moieties.

In some embodiments, the present disclosure provides an oligonucleotide composition comprising a first plurality of oligonucleotides, wherein:

oligonucleotides of the first plurality have the same base sequence;

oligonucleotides of the first plurality comprise 2, 3, 4, 5, 6, 7, 8, 9, 10, 11, 12, 13, 14, 15, 16, 17, 18, 19, 20 or more consecutive nucleoside units comprising 2'-F modified sugar moieties, and 2, 3, 4, 5, 6, 7, 8, 9, 10, 11, 12, 13, 14, 15, 16, 17, 18, 19, 20 or more modified internucleotidic linkages.

In some embodiments, the present disclosure provides an oligonucleotide composition comprising a first plurality of oligonucleotides, wherein:

oligonucleotides of the first plurality have the same base sequence;

oligonucleotides of the first plurality comprise 2, 3, 4, 5, 6, 7, 8, 9, 10, 11, 12, 13, 14, 15, 16, 17, 18, 19, 20 or more consecutive nucleoside units comprising 2'-F modified sugar moieties, 2, 3, 4, 5, 6, 7, 8, 9, 10, 11, 12, 13, 14, 15, 16, 17, 18, 19, 20 or more modified internucleotidic linkages, and 2, 3, 4, 5, 6, 7, 8, 9, 10 or more natural phosphate linkages.

In some embodiments, the present disclosure provides an oligonucleotide composition comprising a first plurality of oligonucleotides, wherein:

oligonucleotides of the first plurality have the same base sequence;

oligonucleotides of the first plurality comprise 2, 3, 4, 5, 6, 7, 8, 9, 10, 11, 12, 13, 14, 15, 16, 17, 18, 19, 20 or more consecutive nucleoside units comprising 2'-F modified sugar moieties, and 2, 3, 4, 5, 6, 7, 8, 9, 10, 11, 12, 13, 14, 15, 16, 17, 18, 19, 20 or more chirally controlled modified internucleotidic linkages.

In some embodiments, the present disclosure provides an oligonucleotide composition comprising a first plurality of oligonucleotides, wherein:

oligonucleotides of the first plurality have the same base sequence;

oligonucleotides of the first plurality comprise 2, 3, 4, 5, 6, 7, 8, 9, 10, 11, 12, 13, 14, 15, 16, 17, 18, 19, 20 or more consecutive nucleoside units comprising 2'-F modified sugar moieties, 2, 3, 4, 5, 6, 7, 8, 9, 10, 11, 12, 13, 14, 15, 16, 17, 18, 19, 20 or more chirally controlled modified internucleotidic linkages, and 2, 3, 4, 5, 6, 7, 8, 9, 10 or more natural phosphate linkages.

In some embodiments, the present disclosure provides a chirally controlled oligonucleotide composition comprising a predetermined level of first plurality of oligonucleotides, wherein:

oligonucleotides of the first plurality have the same base sequence;

oligonucleotides of the first plurality comprise a 5'-end region comprising 2, 3, 4, 5, 6, 7, 8, 9, 10 or more consecutive nucleoside units comprising 2'-F modified sugar moieties, and 2, 3, 4, 5, 6, 7, 8, 9, 10, 11, 12, 13, 14, 15, 16, 17, 18, 19, 20 or more modified internucleotidic linkages, and optionally a 3'-end region comprising 2, 3, 4, 5, 6, 7, 8, 9, 10 or more consecutive nucleoside units comprising 2'-F modified sugar moieties.

In some embodiments, the present disclosure provides a chirally controlled oligonucleotide composition comprising a predetermined level of first plurality of oligonucleotides, wherein:

oligonucleotides of the first plurality have the same base sequence;

oligonucleotides of the first plurality comprise a 5'-end region comprising 2, 3, 4, 5, 6, 7, 8, 9, 10 or more consecutive nucleoside units comprising 2'-F modified sugar moieties, and 2, 3, 4, 5, 6, 7, 8, 9, 10, 11, 12, 13, 14, 15, 16, 17, 18, 19, 20 or more modified internucleotidic linkages, and a 3'-end region comprising 2, 3, 4, 5, 6, 7, 8, 9, 10 or more consecutive nucleoside units comprising 2'-F modified sugar moieties.

In some embodiments, the present disclosure provides a chirally controlled oligonucleotide composition comprising a predetermined level of first plurality of oligonucleotides, wherein:

oligonucleotides of the first plurality have the same base sequence;

oligonucleotides of the first plurality comprise a 5'-end region comprising 2, 3, 4, 5, 6, 7, 8, 9, 10 or more consecutive nucleoside units comprising 2'-F modified sugar moieties wherein the first nucleoside unit of the consecutive nucleoside units is the first nucleoside unit of the oligonucleotide, and 2, 3, 4, 5, 6, 7, 8, 9, 10, 11, 12, 13, 14, 15, 16, 17, 18, 19, 20 or more modified internucleotidic linkages, and a 3'-end region comprising 2, 3, 4, 5, 6, 7, 8, 9, 10 or more consecutive nucleoside units comprising 2'-F modified sugar moieties wherein the last nucleoside unit of the consecutive nucleoside units is the last nucleoside unit of the oligonucleotide.

In some embodiments, the present disclosure provides a chirally controlled oligonucleotide composition comprising a first plurality of oligonucleotides, wherein:

oligonucleotides of the first plurality have the same base sequence;

oligonucleotides of the first plurality comprise 2, 3, 4, 5, 6, 7, 8, 9, 10 or more consecutive nucleoside units comprising 2'-F modified sugar moieties, 2, 3, 4, 5, 6, 7, 8, 9, 10, 11, 12, 13, 14, 15, 16, 17, 18, 19, 20 or more modified internucleotidic linkages, and 2, 3, 4, 5, 6, 7, 8, 9, 10 or more natural phosphate linkages.

In some embodiments, the present disclosure provides a chirally controlled oligonucleotide composition comprising a predetermined level of first plurality of oligonucleotides, wherein:

oligonucleotides of the first plurality have the same base sequence;

oligonucleotides of the first plurality comprise a 5'-end region comprising 2, 3, 4, 5, 6, 7, 8, 9, 10 or more consecutive nucleoside units comprising 2'-F modified sugar moieties, 2, 3, 4, 5, 6, 7, 8, 9, 10, 11, 12, 13, 14, 15, 16, 17, 18, 19, 20 or more modified internucleotidic linkages, 2, 3, 4, 5, 6, 7, 8, 9, 10 or more natural phosphate linkages, and a 3'-end region comprising 2, 3, 4, 5, 6, 7, 8, 9, 10 or more consecutive nucleoside units comprising 2'-F modified sugar moieties.

In some embodiments, the present disclosure provides a chirally controlled oligonucleotide composition comprising a predetermined level of first plurality of oligonucleotides, wherein:

oligonucleotides of the first plurality have the same base sequence;

oligonucleotides of the first plurality comprise a 5'-end region comprising 2, 3, 4, 5, 6, 7, 8, 9, 10 or more consecutive nucleoside units comprising 2'-F modified sugar moieties wherein the first nucleoside unit of the consecutive nucleoside units is the first nucleoside unit of the oligonucleotide, 2, 3, 4, 5, 6, 7, 8, 9, 10, 11, 12, 13, 14, 15, 16, 17, 18, 19, 20 or more modified internucleotidic linkages, 2, 3, 4, 5, 6, 7, 8, 9, 10 or more natural phosphate linkages, and a 3'-end region comprising 2, 3, 4, 5, 6, 7, 8, 9, 10 or more consecutive nucleoside units comprising 2'-F modified sugar moieties wherein the last nucleoside unit of the consecutive nucleoside units is the last nucleoside unit of the oligonucleotide.

In some embodiments, the present disclosure provides a chirally controlled oligonucleotide composition comprising a predetermined level of first plurality of oligonucleotides, wherein:

oligonucleotides of the first plurality have the same base sequence;

oligonucleotides of the first plurality comprise a 5'-end region comprising 2, 3, 4, 5, 6, 7, 8, 9, 10 or more consecutive nucleoside units comprising 2'-F modified sugar moieties wherein the first nucleoside unit of the consecutive nucleoside units is the first nucleoside unit of the oligonucleotide, 2, 3, 4, 5, 6, 7, 8, 9, 10, 11, 12, 13, 14, 15, 16, 17, 18, 19, 20 or more modified internucleotidic linkages, 2, 3, 4, 5, 6, 7, 8, 9, 10 or more natural phosphate linkages, a 3'-end region comprising 2, 3, 4, 5, 6, 7, 8, 9, 10 or more consecutive nucleoside units comprising 2'-F modified sugar moieties wherein the last nucleoside unit of the consecutive nucleoside units is the last nucleoside unit of the oligonucleotide, and 2, 3, 4, 5, 6, 7, 8, 9, 10 or more sugar moieties comprising 2'-OR$^1$ modifications, wherein $R^1$ is optionally substituted $C_{1-6}$ aliphatic.

In some embodiments, a 5'-end region comprises 2 or more consecutive nucleoside units comprising 2'-F. In some embodiments, a 5'-end region comprises 3 or more consecutive nucleoside units comprising 2'-F. In some embodiments, a 5'-end region comprises 4 or more consecutive nucleoside units comprising 2'-F. In some embodiments, a 5'-end region comprises 5 or more consecutive nucleoside units comprising 2'-F. In some embodiments, a 5'-end region comprises 6 or more consecutive nucleoside units comprising 2'-F. In some embodiments, a 5'-end region comprises 7 or more consecutive nucleoside units comprising 2'-F. In some embodiments, a 5'-end region comprises 8 or more consecutive nucleoside units comprising 2'-F. In some embodiments, a 5'-end region comprises 9 or more consecutive nucleoside units comprising 2'-F. In some embodiments, a 5'-end region comprises 10 or more consecutive nucleoside units comprising 2'-F. In some embodiments, a 3'-end region comprises 2 or more consecutive nucleoside units comprising 2'-F. In some embodiments, a 3'-end region comprises 3 or more consecutive nucleoside units comprising 2'-F. In some embodiments, a 3'-end region comprises 4 or more consecutive nucleoside units comprising 2'-F. In some embodiments, a 3'-end region comprises 5 or more consecutive nucleoside units comprising 2'-F. In some embodiments, a 3'-end region comprises 6 or more consecutive nucleoside units comprising 2'-F. In some embodiments, a 3'-end region comprises 7 or more consecutive nucleoside units comprising 2'-F. In some embodiments, a 3'-end region comprises 8 or more consecutive nucleoside units comprising 2'-F. In some embodiments, a 3'-end region comprises 9 or more consecutive nucleoside units comprising 2'-F. In some embodiments, a 3'-end region comprises 10 or more consecutive nucleoside units comprising 2'-F.

In some embodiments, each of the consecutive nucleoside units is independently preceded and/or followed by a modified internucleotidic linkage. In some embodiments, each of the consecutive nucleoside units is independently preceded and/or followed by a phosphorothioate linkage. In some embodiments, each of the consecutive nucleoside units is independently preceded and/or followed by a chirally controlled modified internucleotidic linkage. In some embodiments, each of the consecutive nucleoside units is independently preceded and/or followed by a chirally controlled phosphorothioate linkage. In some embodiments, a modified internucleotidic linkage has a structure of formula I. In some embodiments, a modified internucleotidic linkage has a structure of formula I-a.

In some embodiments, the present disclosure provides a chirally controlled oligonucleotide composition comprising a predetermined level of first plurality of oligonucleotides, wherein:

oligonucleotides of the first plurality have the same base sequence;

oligonucleotides of the first plurality comprise a 5'-end region comprising 2, 3, 4, 5, 6, 7, 8, 9, 10 or more consecutive Sp modified internucleotidic linkages, a 3'-end region comprising 2, 3, 4, 5, 6, 7, 8, 9, 10 or more consecutive Sp modified internucleotidic linkages, and a middle region between the 5'-end region and the 3'-region comprising 1, 2, 3, 4, 5, 6, 7, 8, 9, 10 or more natural phosphate linkages.

In some embodiments, a 5'-end region comprises 2 or more consecutive Sp modified internucleotidic linkages. In some embodiments, a 5'-end region comprises 3 or more consecutive Sp modified internucleotidic linkages. In some embodiments, a 5'-end region comprises 4 or more consecutive Sp modified internucleotidic linkages. In some embodiments, a 5'-end region comprises 5 or more consecutive Sp modified internucleotidic linkages. In some embodiments, a 5'-end region comprises 6 or more consecutive Sp modified internucleotidic linkages. In some embodiments, a 5'-end region comprises 7 or more consecutive Sp modified internucleotidic linkages. In some embodiments, a 5'-end region comprises 8 or more consecutive Sp modified internucleotidic linkages. In some embodiments, a 5'-end region comprises 9 or more consecutive Sp modified internucleotidic linkages. In some embodiments, a 5'-end region comprises 10 or more consecutive Sp modified internucleotidic linkages. In some embodiments, a 3'-end region comprises 2 or more consecutive Sp modified internucleotidic linkages. In some embodiments, a 3'-end region comprises 3 or more consecutive Sp modified internucleotidic linkages. In some embodiments, a 3'-end region comprises 4 or more consecutive Sp modified internucleotidic linkages. In some embodiments, a 3'-end region comprises 5 or more consecutive Sp modified internucleotidic linkages. In some embodiments, a 3'-end region comprises 6 or more consecutive Sp modified internucleotidic linkages. In some embodiments, a 3'-end region comprises 7 or more consecutive Sp modified internucleotidic linkages. In some embodiments, a 3'-end region comprises 8 or more consecutive Sp modified internucleotidic linkages. In some embodiments, a 3'-end region comprises 9 or more consecutive Sp modified internucleotidic linkages. In some embodiments, a 3'-end region comprises 10 or more consecutive Sp modified internucleotidic linkages.

In some embodiments, the present disclosure provides a chirally controlled oligonucleotide composition comprising a predetermined level of first plurality of oligonucleotides, wherein:

- oligonucleotides of the first plurality have the same base sequence;
- oligonucleotides of the first plurality comprise a 5'-end region comprising 4, 5, 6, 7, 8, 9, 10 or more consecutive Sp modified internucleotidic linkages, a 3'-end region comprising 4, 5, 6, 7, 8, 9, 10 or more consecutive Sp modified internucleotidic linkages, and a middle region between the 5'-end region and the 3'-region comprising 1, 2, 3, 4, 5, 6, 7, 8, 9, 10 or more natural phosphate linkages.

In some embodiments, the present disclosure provides a chirally controlled oligonucleotide composition comprising a predetermined level of first plurality of oligonucleotides, wherein:

- oligonucleotides of the first plurality have the same base sequence;
- oligonucleotides of the first plurality comprise a 5'-end region comprising 5, 6, 7, 8, 9, 10 or more consecutive Sp modified internucleotidic linkages, a 3'-end region comprising 5, 6, 7, 8, 9, 10 or more consecutive Sp modified internucleotidic linkages, and a middle region between the 5'-end region and the 3'-region comprising 2, 3, 4, 5, 6, 7, 8, 9, 10 or more natural phosphate linkages.

In some embodiments, the present disclosure provides a chirally controlled oligonucleotide composition comprising a predetermined level of first plurality of oligonucleotides, wherein:

- oligonucleotides of the first plurality have the same base sequence;
- oligonucleotides of the first plurality comprise a 5'-end region comprising 6, 7, 8, 9, 10 or more consecutive Sp modified internucleotidic linkages, a 3'-end region comprising 6, 7, 8, 9, 10 or more consecutive Sp modified internucleotidic linkages, and a middle region between the 5'-end region and the 3'-region comprising 2, 3, 4, 5, 6, 7, 8, 9, 10 or more natural phosphate linkages.

In some embodiments, the present disclosure provides a chirally controlled oligonucleotide composition comprising a predetermined level of first plurality of oligonucleotides, wherein:

- oligonucleotides of the first plurality have the same base sequence;
- oligonucleotides of the first plurality comprise a 5'-end region comprising 6, 7, 8, 9, 10 or more consecutive Sp modified internucleotidic linkages, a 3'-end region comprising 6, 7, 8, 9, 10 or more consecutive Sp modified internucleotidic linkages, and a middle region between the 5'-end region and the 3'-region comprising 3, 4, 5, 6, 7, 8, 9, 10 or more natural phosphate linkages.

In some embodiments, a modified internucleotidic linkage has a structure of formula I. In some embodiments, a modified internucleotidic linkage has a structure of formula I-a.

As demonstrated in the present disclosure, in some embodiments, a provided oligonucleotide composition is characterized in that, when it is contacted with the transcript in a transcript splicing system, splicing of the transcript is altered relative to that observed under reference conditions selected from the group consisting of absence of the composition, presence of a reference composition, and combinations thereof. In some embodiments, a desired splicing product is increased 10%, 20%, 30%, 40%, 50%, 60%, 70%, 80%, 90%, 100%, or 2, 3, 4, 5, 6, 7, 8, 9, 10, 11, 12, 13, 14, 15, 16, 17, 18, 19, 20, 21, 22, 23, 24, 25, 26, 27, 28, 29, 30, 40, 50, 60, 70, 80, 90, 100, 200, 300, 400, 500, 600, 700, 800, 900, 1000 fold or more. In some embodiments, a desired splicing reference is absent (e.g., cannot be reliably detected by quantitative PCR) under reference conditions. In some embodiments, as exemplified in the present disclosure, levels of the plurality of oligonucleotides, e.g., a first plurality of oligonucleotides, in provided compositions are pre-determined.

In some embodiments, a provide oligonucleotide composition comprising a first plurality of oligonucleotides, each of which has the structure of:

$$5'\text{-}[Nu^5]_{z1}\text{-}[Nu^m]_{z2}\text{-}[Nu^3]_{z3}\text{-}3',$$

wherein:

- each $Nu^5$ is independently a nucleotidic unit, and at least one is $Nu^S$ or $Nu^F$;
- each $Nu^3$ is independently a nucleotidic unit, and at least one is $Nu^S$ or $Nu^F$;
- each $Nu^S$ is independently a nucleotidic unit comprising a modified internucleotidic linkage;
- each $Nu^F$ is independently a nucleotidic unit comprises —F;
- each of z1, z2 and z3 is independently 0-100, wherein at least one of z1, z2 and z3 is not 0; and
- each $Nu^m$ is independently a nucleotidic unit.

In some embodiments, a provide oligonucleotide composition comprising a first plurality of oligonucleotides, each of which has the structure of:

$$5'—[Nu^5]_{z1}—[Nu^m]_{z2}—[Nu^3]_{z3}—3',$$

wherein:

- each $Nu^5$ is independently a nucleotidic unit, and at least one is $Nu^S$ or $Nu^F$;
- each $Nu^3$ is independently a nucleotidic unit, and at least one is $Nu^S$ or $Nu^F$;
- each $Nu^S$ is independently a nucleotidic unit comprising a modified internucleotidic linkage;
- each $Nu^F$ is independently a nucleotidic unit comprises —F;

each of z1, z2 and z3 is independently 0-100, wherein at least one of z1, z2 and z3 is not 0;

each $Nu^m$ is independently a nucleotidic unit; and the first plurality of oligonucleotides are structurally identical.

In some embodiments, a provide oligonucleotide composition comprising a first plurality of oligonucleotides, each of which has the structure of:

$$5'\text{-}[Nu^5]_{z1}\text{-}[Nu^m]_{z2}\text{-}[Nu^3]_{z3}\text{-}3',$$

wherein:

each $Nu^S$ is independently a nucleotidic unit comprising a modified internucleotidic linkage;

each of z1, z2 and z3 is independently 0-100, wherein at least one of z1, z2 and z3 is not 0; and each $Nu^m$ is independently a nucleotidic unit.

In some embodiments, a provide oligonucleotide composition comprising a first plurality of oligonucleotides, each of which has the structure of:

$$5'—[Nu^S]_{z1}—[Nu^m]_{z2}—[Nu^3]_{z3}—3',$$

wherein:

each $Nu^S$ is independently a nucleotidic unit comprising a modified internucleotidic linkage;

each of z1, z2 and z3 is independently 0-100, wherein at least one of z1, z2 and z3 is not 0;

each $Nu^m$ is independently a nucleotidic unit; and the first plurality of oligonucleotides are structurally identical.

In some embodiments, a provide oligonucleotide composition comprising a first plurality of oligonucleotides, each of which has the structure of:

$$5'\text{-}[Nu^F]_{z1}\text{-}[Nu^m]_{z2}\text{-}[Nu^F]_{z3}\text{-}3',$$

wherein:

each $Nu^F$ is independently a nucleotidic unit comprises —F;

each of z1, z2 and z3 is independently 0-100, wherein at least one of z1, z2 and z3 is not 0; and each $Nu^m$ is independently a nucleotidic unit.

In some embodiments, a provide oligonucleotide composition comprising a first plurality of oligonucleotides, each of which has the structure of:

$$5'\text{-}[Nu^F]_{z1}\text{-}[Nu^m]_{z2}\text{-}[Nu^F]_{z3}\text{-}3',$$

wherein:

each $Nu^F$ is independently a nucleotidic unit comprises —F;

each of z1, z2 and z3 is independently 0-100, wherein at least one of z1, z2 and z3 is not 0;

each $Nu^m$ is independently a nucleotidic unit; and the first plurality of oligonucleotides are structurally identical.

In some embodiments, $A^c$ is $-5'\text{-}[Nu^5]_{z1}\text{-}[Nu^m]_{z2}\text{-}[Nu^3]_{z3}\text{-}3'$. In some embodiments, $A^c$ is $-5'\text{-}[Nu^S]_{z1}\text{-}[Nu^m]_{z2}\text{-}[Nu^S]_{z3}\text{-}3'$. In some embodiments, $A^c$ is $-5'\text{-}[Nu^F]_{z1}\text{-}[Nu^m]_{z2}\text{-}[Nu^F]_{z3}\text{-}3$.

In some embodiments, at least one $Nu^5$ is $Nu^S$. In some embodiments, at least one $Nu^3$ is $Nu^S$. In some embodiments, at least one $Nu^5$ is $Nu^S$ and at least one $Nu^3$ is $Nu^S$. In some embodiments, each $Nu^5$ and $Nu^3$ is independently $Nu^S$. In some embodiments, at least one $Nu^5$ is $Nu^F$. In some embodiments, at least one $Nu^3$ is $Nu^F$. In some embodiments, at least one $Nu^5$ is $Nu^F$ and at least one $Nu^3$ is $Nu^F$. In some embodiments, each $Nu^5$ and $Nu^3$ is independently $Nu^F$.

In some embodiments, $Nu^S$ comprises a modified internucleotidic linkage having the structure of formula I. In some embodiments, $Nu^S$ comprises a modified internucleotidic linkage having the structure of formula I-a. In some embodiments, a modified internucleotidic linkage is a phosphorothioate linkage. In some embodiments, a modified internucleotidic linkage is chirally controlled. In some embodiments, a modified internucleotidic linkage is chirally controlled and Sp. In some embodiments, each modified internucleotidic linkage is chirally controlled and Sp. In some embodiments, a modified internucleotidic linkage is chirally controlled and Rp. In some embodiments, each modified internucleotidic linkage is chirally controlled and Rp. In some embodiments, each $Nu^S$ comprises a phosphorothioate linkage. In some embodiments, each $Nu^S$ comprises a chirally controlled phosphorothioate linkage. In some embodiments, each $Nu^S$ comprises a chirally controlled Sp phosphorothioate linkage. In some embodiments, each $Nu^S$ comprises a chirally controlled Rp phosphorothioate linkage. In some embodiments, $Nu^S$ comprises —F. In some embodiments, $Nu^S$ comprises a sugar moiety comprising —F. In some embodiments, $Nu^S$ comprises a 2'-F sugar moiety. In some embodiments, each $Nu^S$ comprises a 2'-F sugar moiety. In some embodiments, $Nu^S$ comprises a modified sugar moiety. In some embodiments, $Nu^S$ comprises a 2'-modified sugar moiety. In some embodiments, $Nu^S$ comprises a 2'-$R^1$ modified sugar moiety. In some embodiments, $Nu^S$ comprises a 2'-$OR^1$ modified sugar moiety. In some embodiments, $Nu^S$ comprises a 2'-$OR^1$ modified sugar moiety, wherein $R^1$ is optionally substituted $C_{1-6}$ aliphatic. In some embodiments, $Nu^S$ comprises a 2'-MOE modified sugar moiety. In some embodiments, $Nu^S$ comprises a 2'-OMe modified sugar moiety.

In some embodiments, $Nu^F$ comprises a sugar moiety comprising —F. In some embodiments, $Nu^F$ comprises a 2'-F sugar moiety. In some embodiments, each $Nu^F$ comprises a 2'-F sugar moiety. In some embodiments, $Nu^F$ comprises a modified internucleotidic linkage. In some embodiments, $Nu^F$ comprises a modified internucleotidic linkage of formula I. In some embodiments, $Nu^S$ comprises a modified internucleotidic linkage having the structure of formula I-a. In some embodiments, $Nu^F$ comprises a chirally controlled modified internucleotidic linkage. In some embodiments, $Nu^F$ comprises a chirally controlled, Sp modified internucleotidic linkage. In some embodiments, $Nu^F$ comprises a phosphorothioate linkage. In some embodiments, Nu comprises a chirally controlled phosphorothioate linkage. In some embodiments, $Nu^F$ comprises a chirally controlled Sp phosphorothioate linkage. In some embodiments, $Nu^F$ is a 2'-F phosphorothioate unit. In some embodiments, $Nu^F$ is a chirally controlled 2'-F phosphorothioate unit. In some embodiments, $Nu^F$ is a chirally controlled Sp 2'-F phosphorothioate unit. In some embodiments, each $Nu^F$ is a chirally controlled Sp 2'-F phosphorothioate unit. In some embodiments, a modified internucleotidic linkage has the structure of formula I. In some embodiments, a modified internucleotidic linkage has the structure of formula I-a.

In some embodiments, $Nu^m$ comprises a modified sugar moiety. In some embodiments, $Nu^m$ comprises a 2'-modified sugar moiety. In some embodiments, $Nu^m$ comprises a 2'-$OR^1$ modified sugar moiety. In some embodiments, $Nu^m$ comprises a 2'-F modified sugar moiety. In some embodiments, at least one $Nu^m$ comprises a 2'-$OR^1$ modified sugar moiety. In some embodiments, at least one $Nu^m$ comprises a 2'-$OR^1$ modified sugar moiety, wherein $R^1$ is optionally substituted $C_{1-6}$ alkyl. In some embodiments, at least one $Nu^m$ comprises a 2'-F modified sugar moiety. In some embodiments, at least one $Nu^m$ comprises a 2'-$OR^1$ modified sugar moiety, and at least one $Nu^m$ comprises a 2'-F modified sugar moiety. In some embodiments, at least one $Nu^m$ comprises a 2'-$OR^1$ modified sugar moiety, and at least one $Nu^m$ comprises a 2'-F modified sugar moiety, wherein $R^1$ is optionally substituted $C_{1-6}$ aliphatic. In some embodiments, at least one $Nu^m$ comprises a 2'-OMe modified sugar moiety, and at least one $Nu^m$ comprises a 2'-F modified sugar moiety.

In some embodiments, $Nu^m$ comprises a natural phosphate linkage. In some embodiments, $Nu^m$ comprises a modified internucleotidic linkage. In some embodiments, $Nu^m$ comprises a phosphorothioate linkage. In some embodiments, $Nu^m$ comprises a chirally controlled modified internucleotidic linkage. In some embodiments, $Nu^m$ comprises a chirally controlled Sp modified internucleotidic linkage. In some embodiments, $Nu^m$ comprises a chirally controlled Rp modified internucleotidic linkage. In some embodiments, $Nu^m$ comprises a chirally controlled phosphorothioate linkage. In some embodiments, $Nu^m$ comprises a chirally controlled Sp phosphorothioate linkage. In some embodiments, $Nu^m$ comprises a chirally controlled Rp phosphorothioate linkage. In some embodiments, at least one $Nu^m$ comprises a natural phosphate linkage, and at least one $Nu^m$ comprises a modified internucleotidic linkage. In some embodiments, at least one $Nu^m$ comprises a natural phosphate linkage, and at least one $Nu^m$ comprises a chirally controlled modified internucleotidic linkage. In some embodiments, at least one $Nu^m$ comprises a natural phosphate linkage, and at least one $Nu^m$ comprises a chirally controlled Sp modified internucleotidic linkage. In some embodiments, at least one $Nu^m$ comprises a natural phosphate linkage, and at least one $Nu^m$ comprises a chirally controlled Rp modified internucleotidic linkage. In some embodiments, at least one $Nu^m$ comprises a natural phosphate linkage, and at least one $Nu^m$ comprises a phosphorothioate linkage. In some embodiments, at least one $Nu^m$ comprises a natural phosphate linkage, and at least one $Nu^m$ comprises a chirally controlled phosphorothioate linkage. In some embodiments, at least one $Nu^m$ comprises a natural phosphate linkage, and at least one $Nu^m$ comprises a chirally controlled Sp phosphorothioate linkage. In some embodiments, at least one $Nu^m$ comprises a natural phosphate linkage, and at least one $Nu^m$ comprises a chirally controlled Rp phosphorothioate linkage. In some embodiments, a modified internucleotidic linkage has the structure of formula I. In some embodiments, a modified internucleotidic linkage has the structure of formula I-a.

In some embodiments, each of $Nu^S$, $Nu^F$ and $Nu^m$ independently has the structure of

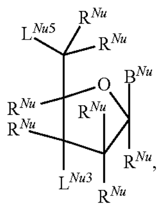

wherein $B^{Nu}$ is an optionally substituted nucleobase; each $R^{Nu}$ is independently $R^1$, R', -L-$R^1$, or -L-R', wherein each of $R^1$, R', and L is independently as defined and described; $L^{Nu5}$ is a covalent bond, or if at the 5'-end of an oligonucleotide, $R^{Nu}$; and $L^{Nu3}$ is a internucleotidic linkage having the structure of formula I, or if at the 3'-end of an oligonucleotide, $R^{Nu}$. In some embodiments, each of $Nu^S$, $Nu^F$ and $Nu^m$ independently has the structure of

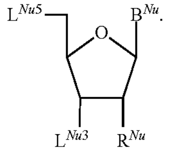

In some embodiments, $B^{Nu}$ is optionally substituted A, T, C, G and U. In some embodiments, two $R^{Nu}$ groups are taken together with their intervening atoms to form a ring system. In some embodiments, the 2'-$R^{Nu}$ is 2'-$OR^1$, in some embodiments, 2'-OMe, 2'-MOE, etc. In some embodiments, the 2'-$R^{Nu}$ is 2'-F. In some embodiments, $L^{Nu5}$ is a covalent bond. In some embodiments, $L^{Nu5}$ is 5'-OH or protected 5'-OH. In some embodiments, $L^{Nu3}$ has the structure of formula I. In some embodiments, $L^{Nu3}$ is 3'-OH or protected 3'-OH.

In some embodiments, z1 is not 0. In some embodiments, z3 is not 0. In some embodiments, z1 and z3 are not zero. In some embodiments, the sum of z1, z2 and z3 are 10, 11, 12, 13, 14, 15, 16, 17, 18, 19, 20, 21, 22, 23, 24, 25, 26, 27, 28, 29, 30, 35, 40, 50 or more. In some embodiments, the sum of z1, z2, and z3 are 15 or more. In some embodiments, the sum of z1, z2, and z3 are 16 or more. In some embodiments, the sum of z1, z2, and z3 are 17 or more. In some embodiments, the sum of z1, z2, and z3 are 18 or more. In some embodiments, the sum of z1, z2, and z3 are 19 or more. In some embodiments, the sum of z1, z2, and z3 are 20 or more.

In some embodiments, z1 is 0. In some embodiments, z1 is 1. In some embodiments, z1 is 2. In some embodiments, z1 is 3. In some embodiments, z1 is 4. In some embodiments, z1 is 5. In some embodiments, z1 is 6. In some embodiments, z1 is 7. In some embodiments, z1 is 8. In some embodiments, z1 is 0. In some embodiments, z1 is 10. In some embodiments, z1 is 1 or more. In some embodiments, z1 is 2 or more. In some embodiments, z1 is 3 or more. In some embodiments, z1 is 4 or more. In some embodiments, z1 is 5 or more. In some embodiments, z1 is 6 or more. In some embodiments, z1 is 7 or more. In some embodiments, z1 is 8 or more. In some embodiments, z1 is 0 or more. In some embodiments, z1 is 10 or more.

In some embodiments, z2 is 0. In some embodiments, z2 is 1. In some embodiments, z2 is 2. In some embodiments, z2 is 3. In some embodiments, z2 is 4. In some embodiments, z2 is 5. In some embodiments, z2 is 6. In some embodiments, z2 is 7. In some embodiments, z2 is 8. In some embodiments, z2 is 0. In some embodiments, z2 is 10. In some embodiments, z2 is 1 or more. In some embodiments, z2 is 2 or more. In some embodiments, z2 is 3 or more. In some embodiments, z2 is 4 or more. In some embodiments, z2 is 5 or more. In some embodiments, z2 is 6 or more. In some embodiments, z2 is 7 or more. In some embodiments, z2 is 8 or more. In some embodiments, z2 is 0 or more. In some embodiments, z2 is 10 or more.

In some embodiments, z3 is 0. In some embodiments, z3 is 1. In some embodiments, z3 is 2. In some embodiments, z3 is 3. In some embodiments, z3 is 4. In some embodiments, z3 is 5. In some embodiments, z3 is 6. In some embodiments, z3 is 7. In some embodiments, z3 is 8. In some embodiments, z3 is 0. In some embodiments, z3 is 10. In some embodiments, z3 is 1 or more. In some embodiments, z3 is 2 or more. In some embodiments, z3 is 3 or more. In some embodiments, z3 is 4 or more. In some embodiments, z3 is 5 or more. In some embodiments, z3 is 6 or more. In some embodiments, z3 is 7 or more. In some embodiments, z3 is 8 or more. In some embodiments, z3 is 0 or more. In some embodiments, z3 is 10 or more.

In some embodiments, each of z1 and z3 is independently 2 or more. In some embodiments, each of z1 and z3 is independently 3 or more. In some embodiments, each of z1 and z3 is independently 4 or more. In some embodiments, each of z1 and z3 is independently 5 or more. In some embodiments, each of z1 and z3 is independently 6 or more. In some embodiments, each of z1 and z3 is independently 7 or more. In some embodiments, each of z1 and z3 is independently 8 or more. In some embodiments, each of z1 and z3 is independently 9 or more. In some embodiments, each of z1 and z3 is independently 10 or more. In some embodiments, z1 equals z3.

In some embodiments, $[Nu^5]_{z1}$ is a 5'-wing. In some embodiments, $[Nu^S]_{z1}$ is a 5'-wing. In some embodiments, $[Nu^F]_{z1}$ is a 5'-wing. In some embodiments, $[Nu^m]_{z2}$ is a core. In some embodiments, $[Nu^3]_{z3}$ is a 3'-wing. In some embodiments, $[Nu^S]_{z3}$ is a 3'-wing. In some embodiments, $[Nu^F]_{z3}$ is a 3'-wing. In some embodiments, $[Nu^5]_{z1}$ is a 5'-wing, $[Nu^m]_{z2}$ is a core, and $[Nu^3]_{z3}$ is a 5'-wing. In some embodiments, $[Nu^S]_{z1}$ is a 5'-wing, $[Nu^m]_{z2}$ is a core, and $[Nu^S]_{z3}$ is a 5'-wing. In some embodiments, $[Nu^F]_{z1}$ is a 5'-wing, $[Nu^m]_{z2}$ is a core, and $[Nu^F]_{z3}$ is a 5'-wing.

In some embodiments, $[Nu^5]_{z1}$ is a 5'-end region. In some embodiments, $[Nu^S]_{z1}$ is a 5'-end region. In some embodiments, $[Nu^F]_{z1}$ is a 5'-end region. In some embodiments, $[Nu^m]_{z2}$ is a middle region. In some embodiments, $[Nu^3]_{z3}$ is a 3'-end region. In some embodiments, $[Nu^S]_{z3}$ is a 3'-end region. In some embodiments, $[Nu^F]_{z3}$ is a 3'-end region. In some embodiments, $[Nu^5]_{z1}$ is a 5'-end region, $[Nu^m]_{z2}$ is a middle region, and $[Nu^3]_{z3}$ is a 5'-end region. In some embodiments, $[Nu^S]_{z1}$ is a 5'-end region, $[Nu^m]_{z2}$ is a middle region, and $[Nu^S]_{z3}$ is a 5'-end region. In some embodiments, $[Nu^F]_{z1}$ is a 5'-end region, $[Nu^m]_{z2}$ is a middle region, and $[Nu^F]_{z3}$ is a 5'-end region.

An example composition is WV-1497 (mG*mGmCmAmC*A*A*G*G*G*C*A*C*A*G*mAm CmUmU*mC (SEQ ID NO: 7)), wherein the core region is *A*A*G*G*G*C*A*C*A*G* (SEQ ID NO: 8), the wing region to the 5'-end of the core region is mG*mGmCmAmC, and the wing region to the 3'-end of the core region is mAmCmUmU*mC. In some embodiments, a wing region comprises a modified internucleotidic linkage between the two nucleosides at its 3'-end. In some embodiments, a wing region to the 5'-end of a core region comprises a modified internucleotidic linkage between the two nucleosides at its 3'-end. For example, in WV-1497, mG*mGmCmAmC is a wing to the 5'-end of the core region (*A*A*G*G*G*C*A*C*A*G* (SEQ ID NO: 8)), and it comprise a modified internucleotidic linkage between the two nucleosides at its 3'-end (mG*mGmCmAmC). In some embodiments, a wing region comprises a modified internucleotidic linkage between the two nucleosides at its 5'-end. In some embodiments, a wing region to the 3'-end of a core region comprises a modified internucleotidic linkage between the two nucleosides at its 5'-end. For example, in WV-1497, mAmCmUmU*mC is a wing to the 3'-end of the core region (*A*A*G*G*G*C*A*C*A*G* (SEQ ID NO: 8)), and it comprise a modified internucleotidic linkage between the two nucleosides at its 5'-end (mAmCmUmU*mC). WV-3507 is an example oligonucleotide comprising 5'-end and 3'-end regions (can also be considered rings for WV-3507) comprising consecutive Sp 2'-F phosphorothioate nucleotidic units, and a middle (can also be considered core region for WV-3507) comprising natural phosphate linkages and 2'-OMe sugar modifications.

In some embodiments, oligonucleotides of the first plurality have two wing and one core regions. In some embodiments, the two wing regions are identical. In some embodiments, the two wing regions are different.

In some embodiments, a wing region comprises 2 or more modified internucleotidic linkages. In some embodiments, a wing region comprises 3 or more modified internucleotidic linkages. In some embodiments, a wing region comprises 4 or more modified internucleotidic linkages. In some embodiments, a wing region comprises 5 or more modified internucleotidic linkages. In some embodiments, a wing region comprises 6 or more modified internucleotidic linkages. In some embodiments, a wing region comprises 7 or more modified internucleotidic linkages. In some embodiments, a wing region comprises 8 or more modified internucleotidic linkages. In some embodiments, a wing region comprises 9 or more modified internucleotidic linkages. In some embodiments, a wing region comprises 10 or more modified internucleotidic linkages. In some embodiments, a wing region comprises 11 or more modified internucleotidic linkages. In some embodiments, a wing region comprises 12 or more modified internucleotidic linkages. In some embodiments, a wing region comprises 13 or more modified internucleotidic linkages. In some embodiments, a wing region comprises 14 or more modified internucleotidic linkages. In some embodiments, a wing region comprises 15 or more modified internucleotidic linkages. In some embodiments, a wing region comprises 2 or consecutive modified internucleotidic linkages. In some embodiments, a chiral internucleotidic linkage or a modified internucleotidic linkage has the structure of formula I. In some embodiments, a chiral internucleotidic linkage or a modified internucleotidic linkage is phosphorothioate. In some embodiments, each chiral internucleotidic linkage or a modified internucleotidic linkage independently has the structure of formula I. In some embodiments, each chiral internucleotidic linkage or a modified internucleotidic linkage is phosphorothioate. In some embodiments, a wing region comprises 3 or consecutive modified internucleotidic linkages. In some embodiments, a wing region comprises 4 or consecutive modified internucleotidic linkages. In some embodiments, a wing region comprises 5 or consecutive modified internucleotidic linkages. In some embodiments, a wing region comprises 6 or consecutive modified internucleotidic linkages. In some embodiments, a wing region comprises 7 or consecutive modified internucleotidic linkages. In some embodiments, a wing region comprises 8 or consecutive modified internucleotidic linkages. In some embodiments, a wing region comprises 9 or consecutive modified internucleotidic linkages. In some embodiments, a wing region comprises 10 or consecutive modified internucleotidic linkages. In some embodiments, a wing region comprises 11 or consecutive modified internucleotidic linkages. In some embodiments, a wing region comprises 12 or consecutive modified internucleotidic linkages. In some embodiments, a wing region comprises 13 or consecutive modified internucleotidic linkages. In some embodiments, a wing region comprises 14 or consecutive modified internucleotidic linkages. In some embodiments, a wing region comprises 15 or consecutive modified internucleotidic linkages. In some embodiments, each internucleotidic linkage in a wing region is independently a modified internucleotidic linkage.

In some embodiments, 5% or more of the internucleotidic linkages of provided oligonucleotides are modified internucleotidic linkages. In some embodiments, 10% or more of the internucleotidic linkages of provided oligonucleotides are modified internucleotidic linkages. In some embodiments, 15% or more of the internucleotidic linkages of provided oligonucleotides are modified internucleotidic linkages. In some embodiments, 20% or more of the internucleotidic linkages of provided oligonucleotides are modified internucleotidic linkages. In some embodiments, 25% or more of the internucleotidic linkages of provided oligonucleotides are modified internucleotidic linkages. In some embodiments, 30% or more of the internucleotidic linkages of provided oligonucleotides are modified internucleotidic linkages. In some embodiments, 35% or more of the internucleotidic linkages of provided oligonucleotides are modified internucleotidic linkages. In some embodiments, 40% or more of the internucleotidic linkages of provided oligonucleotides are modified internucleotidic linkages. In some embodiments, 45% or more of the internucleotidic linkages of a wing region are modified internucleotidic linkages. In some embodiments, 50% or more of the internucleotidic linkages of a wing region are modified internucleotidic linkages. In some embodiments, 55% or more of the internucleotidic linkages of a wing region are modified internucleotidic linkages. In some embodiments, 60% or more of the internucleotidic linkages of a wing region are modified internucleotidic linkages. In some embodiments, 65% or more of the internucleotidic linkages of a wing region are modified internucleotidic linkages. In some embodiments, 70% or more of the internucleotidic linkages of a wing region are modified internucleotidic linkages. In some embodiments, 75% or more of the internucleotidic linkages of a wing region are modified internucleotidic linkages. In some embodiments, 80% or more of the internucleotidic linkages of a wing region are modified internucleotidic linkages. In some embodiments, 85% or more of the internucleotidic linkages of a wing region are modified internucleotidic linkages. In some embodiments, 90% or more of the internucleotidic linkages of a wing region are modified internucleotidic linkages. In some embodiments, 95% or more of the internucleotidic linkages of a wing region are modified internucleotidic linkages. In some embodiments, each internucleotidic linkage of a wing region is a modified internucleotidic linkage.

In some embodiments, a wing region comprises 2 or more natural phosphate linkages. In some embodiments, a wing region comprises 3 or more natural phosphate linkages. In some embodiments, a wing region comprises 4 or more natural phosphate linkages. In some embodiments, a wing region comprises 5 or more natural phosphate linkages. In some embodiments, a wing region comprises 6 or more natural phosphate linkages. In some embodiments, a wing region comprises 7 or more natural phosphate linkages. In some embodiments, a wing region comprises 8 or more natural phosphate linkages. In some embodiments, a wing region comprises 9 or more natural phosphate linkages. In some embodiments, a wing region comprises 10 or more natural phosphate linkages. In some embodiments, a wing region comprises 11 or more natural phosphate linkages. In some embodiments, a wing region comprises 12 or more natural phosphate linkages. In some embodiments, a wing region comprises 13 or more natural phosphate linkages. In some embodiments, a wing region comprises 14 or more natural phosphate linkages. In some embodiments, a wing region comprises 15 or more natural phosphate linkages. In some embodiments, a wing region comprises 2 or consecutive natural phosphate linkages. In some embodiments, a wing region comprises 3 or consecutive natural phosphate linkages. In some embodiments, a wing region comprises 4 or consecutive natural phosphate linkages. In some embodiments, a wing region comprises 5 or consecutive natural phosphate linkages. In some embodiments, a wing region comprises 6 or consecutive natural phosphate linkages. In some embodiments, a wing region comprises 7 or consecutive natural phosphate linkages. In some embodiments, a wing region comprises 8 or consecutive natural phosphate linkages. In some embodiments, a wing region comprises 9 or consecutive natural phosphate linkages. In some embodiments, a wing region comprises 10 or consecutive natural phosphate linkages. In some embodiments, a wing region comprises 11 or consecutive natural phosphate linkages. In some embodiments, a wing region comprises 12 or consecutive natural phosphate linkages. In some embodiments, a wing region comprises 13 or consecutive natural phosphate linkages. In some embodiments, a wing region comprises 14 or consecutive natural phosphate linkages. In some embodiments, a wing region comprises 15 or consecutive natural phosphate linkages. In some embodiments, each internucleotidic linkage in a wing region is independently a natural phosphate linkage.

In some embodiments, 5% or more of the internucleotidic linkages of provided oligonucleotides are natural phosphate linkages. In some embodiments, 10% or more of the internucleotidic linkages of provided oligonucleotides are natural phosphate linkages. In some embodiments, 15% or more of the internucleotidic linkages of provided oligonucleotides are natural phosphate linkages. In some embodiments, 20% or more of the internucleotidic linkages of provided oligonucleotides are natural phosphate linkages. In some embodiments, 25% or more of the internucleotidic linkages of provided oligonucleotides are natural phosphate linkages. In some embodiments, 30% or more of the internucleotidic linkages of provided oligonucleotides are natural phosphate linkages. In some embodiments, 35% or more of the internucleotidic linkages of provided oligonucleotides are natural phosphate linkages. In some embodiments, 40% or more of the internucleotidic linkages of provided oligonucleotides are natural phosphate linkages. In some embodiments, 45% or more of the internucleotidic linkages of a wing region are natural phosphate linkages. In some embodiments, 50% or more of the internucleotidic linkages of a wing region are natural phosphate linkages. In some embodiments, 55% or more of the internucleotidic linkages of a wing region are natural phosphate linkages. In some embodiments, 60% or more of the internucleotidic linkages of a wing region are natural phosphate linkages. In some embodiments, 65% or more of the internucleotidic linkages of a wing region are natural phosphate linkages. In some embodiments, 70% or more of the internucleotidic linkages of a wing region are natural phosphate linkages. In some embodiments, 75% or more of the internucleotidic linkages of a wing region are natural phosphate linkages. In some embodiments, 80% or more of the internucleotidic linkages of a wing region are natural phosphate linkages. In some embodiments, 85% or more of the internucleotidic linkages of a wing region are natural phosphate linkages. In some embodiments, 90% or more of the internucleotidic linkages of a wing region are natural phosphate linkages. In some embodiments, 95% or more of the internucleotidic linkages of a wing region are natural phosphate linkages. In some embodiments, each internucleotidic linkage of a wing region is a natural phosphate linkage.

In some embodiments, a core region comprises 2 or more modified internucleotidic linkages. In some embodiments, a core region comprises 3 or more modified internucleotidic linkages. In some embodiments, a core region comprises 4 or more modified internucleotidic linkages. In some embodiments, a core region comprises 5 or more modified internucleotidic linkages. In some embodiments, a core region comprises 6 or more modified internucleotidic linkages. In some embodiments, a core region comprises 7 or more modified internucleotidic linkages. In some embodiments, a core region comprises 8 or more modified internucleotidic linkages. In some embodiments, a core region comprises 9 or more modified internucleotidic linkages. In some embodiments, a core region comprises 10 or more modified internucleotidic linkages. In some embodiments, a core region comprises 11 or more modified internucleotidic linkages. In some embodiments, a core region comprises 12 or more modified internucleotidic linkages. In some embodiments, a core region comprises 13 or more modified internucleotidic linkages. In some embodiments, a core region comprises 14 or more modified internucleotidic linkages. In some embodiments, a core region comprises 15 or more modified internucleotidic linkages. In some embodiments, a core region comprises 2 or consecutive modified internucleotidic linkages. In some embodiments, a core region comprises 3 or consecutive modified internucleotidic linkages. In some embodiments, a core region comprises 4 or consecutive modified internucleotidic linkages. In some embodiments, a core region comprises 5 or consecutive modified internucleotidic linkages. In some embodiments, a core region comprises 6 or consecutive modified internucleotidic linkages. In some embodiments, a core region comprises 7 or consecutive modified internucleotidic linkages. In some embodiments, a core region comprises 8 or consecutive modified internucleotidic linkages. In some embodiments, a core region comprises 9 or consecutive modified internucleotidic linkages. In some embodiments, a core region comprises 10 or consecutive modified internucleotidic linkages. In some embodiments, a core region comprises 11 or consecutive modified internucleotidic linkages. In some embodiments, a core region comprises 12 or consecutive modified internucleotidic linkages. In some embodiments, a core region comprises 13 or consecutive modified internucleotidic linkages. In some embodiments, a core region comprises 14 or consecutive modified internucleotidic linkages. In some embodiments, a core region comprises 15 or consecutive modified internucleotidic linkages. In some embodiments, each internucleotidic linkage in a core region is independently a modified internucleotidic linkage.

In some embodiments, 5% or more of the internucleotidic linkages of provided oligonucleotides are modified internucleotidic linkages. In some embodiments, 10% or more of the internucleotidic linkages of provided oligonucleotides are modified internucleotidic linkages. In some embodiments, 15% or more of the internucleotidic linkages of provided oligonucleotides are modified internucleotidic linkages. In some embodiments, 20% or more of the internucleotidic linkages of provided oligonucleotides are modified internucleotidic linkages. In some embodiments, 25% or more of the internucleotidic linkages of provided oligonucleotides are modified internucleotidic linkages. In some embodiments, 30% or more of the internucleotidic linkages of provided oligonucleotides are modified internucleotidic linkages. In some embodiments, 35% or more of the internucleotidic linkages of provided oligonucleotides are modified internucleotidic linkages. In some embodiments, 40% or more of the internucleotidic linkages of provided oligonucleotides are modified internucleotidic linkages. In some embodiments, 45% or more of the internucleotidic linkages of a core region are modified internucleotidic linkages. In some embodiments, 50% or more of the internucleotidic linkages of a core region are modified internucleotidic linkages. In some embodiments, 55% or more of the internucleotidic linkages of a core region are modified internucleotidic linkages. In some embodiments, 60% or more of the internucleotidic linkages of a core region are modified internucleotidic linkages. In some embodiments, 65% or more of the internucleotidic linkages of a core region are modified internucleotidic linkages. In some embodiments, 70% or more of the internucleotidic linkages of a core region are modified internucleotidic linkages. In some embodiments, 75% or more of the internucleotidic linkages of a core region are modified internucleotidic linkages. In some embodiments, 80% or more of the internucleotidic linkages of a core region are modified internucleotidic linkages. In some embodiments, 85% or more of the internucleotidic linkages of a core region are modified internucleotidic linkages. In some embodiments, 90% or more of the internucleotidic linkages of a core region are modified internucleotidic linkages. In some embodiments, 95% or more of the internucleotidic linkages of a core region are modified internucleotidic linkages. In some embodiments, each internucleotidic linkage of a core region is a modified internucleotidic linkage.

In some embodiments, the present disclosure provides a chirally controlled oligonucleotide composition comprising a first plurality of oligonucleotides defined by having:

1) a common base sequence and length;
2) a common pattern of backbone linkages; and
3) a common pattern of backbone chiral centers, which composition is a substantially pure preparation of a single oligonucleotide in that a predetermined level of the oligonucleotides in the composition have the common base sequence and length, the common pattern of backbone linkages, and the common pattern of backbone chiral centers.

In some embodiments, a common base sequence and length may be referred to as a common base sequence. In some embodiments, oligonucleotides having a common base sequence may have the same pattern of nucleoside modifications, e.g., sugar modifications, base modifications, etc. In some embodiments, a pattern of nucleoside modifications may be represented by a combination of locations and modifications. For example, for WV-1092, the pattern of nucleoside linkage is 5×2'-OMe (2'-OMe modification on sugar moieties)-DNA (no 2'-modifications on the sugar moiety)-5×2'-OMe from the 5'-end to the 3'-end. In some embodiments, a pattern of backbone linkages comprises locations and types (e.g., phosphate, phosphorothioate, substituted phosphorothioate, etc.) of each internucleotidic linkages. For example, for WV-1092, the pattern of backbone linkages is 1×PS(phosphorothioate)-3×PO (phosphate)-11×PS-3×PO-1×PS. A pattern of backbone chiral centers of an oligonucleotide can be designated by a combination of linkage phosphorus stereochemistry (Rp/Sp) from 5' to 3'. For example, WV-1092 has a pattern of 1S-3PO (phosphate)-8S-1R-2S-3PO-1S. In some embodiments, all non-chiral linkages (e.g., PO) may be omitted. As exemplified above, locations of non-chiral linkages may be obtained, for example, from pattern of backbone linkages.

In some embodiments, the present disclosure provides a chirally controlled oligonucleotide composition comprising a first plurality of oligonucleotides of a particular oligonucleotide type characterized by:

1) a common base sequence and length;

2) a common pattern of backbone linkages; and 3) a common pattern of backbone chiral centers;

which composition is chirally controlled in that it is enriched, relative to a substantially racemic preparation of oligonucleotides having the same base sequence and length, for oligonucleotides of the particular oligonucleotide type.

As understood by a person having ordinary skill in the art, a stereorandom or racemic preparation of oligonucleotides is prepared by non-stereoselective and/or low-stereoselective coupling of nucleotide monomers, typically without using any chiral auxiliaries, chiral modification reagents, and/or chiral catalysts. In some embodiments, in a substantially racemic (or chirally uncontrolled) preparation of oligonucleotides, all or most coupling steps are not chirally controlled in that the coupling steps are not specifically conducted to provide enhanced stereoselectivity. An example substantially racemic preparation of oligonucleotides is the preparation of phosphorothioate oligonucleotides through sulfurizing phosphite triesters from commonly used phosphoramidite oligonucleotide synthesis with either tetraethylthiuram disulfide or (TETD) or 3H-1, 2-bensodithiol-3-one 1, 1-dioxide (BDTD), a well-known process in the art. In some embodiments, substantially racemic preparation of oligonucleotides provides substantially racemic oligonucleotide compositions (or chirally uncontrolled oligonucleotide compositions). In some embodiments, at least one coupling of a nucleotide monomer has a diastereoselectivity lower than about 60:40, 70:30, 80:20, 85:15, 90:10, 91:9, 92:8, 97:3, 98:2, or 99:1. In some embodiments, at least two couplings of a nucleotide monomer have a diastereoselectivity lower than about 60:40, 70:30, 80:20, 85:15, 90:10, 91:9, 92:8, 97:3, 98:2, or 99:1. In some embodiments, at least three couplings of a nucleotide monomer have a diastereoselectivity lower than about 60:40, 70:30, 80:20, 85:15, 90:10, 91:9, 92:8, 97:3, 98:2, or 99:1. In some embodiments, at least four couplings of a nucleotide monomer have a diastereoselectivity lower than about 60:40, 70:30, 80:20, 85:15, 90:10, 91:9, 92:8, 97:3, 98:2, or 99:1. In some embodiments, at least five couplings of a nucleotide monomer have a diastereoselectivity lower than about 60:40, 70:30, 80:20, 85:15, 90:10, 91:9, 92:8, 97:3, 98:2, or 99:1. In some embodiments, each coupling of a nucleotide monomer independently has a diastereoselectivity lower than about 60:40, 70:30, 80:20, 85:15, 90:10, 91:9, 92:8, 97:3, 98:2, or 99:1. In some embodiments, in a stereorandom or racemic preparations, at least one internucleotidic linkage has a diastereoselectivity lower than about 60:40, 70:30, 80:20, 85:15, 90:10, 91:9, 92:8, 97:3, 98:2, or 99:1. In some embodiments, at least two internucleotidic linkages have a diastereoselectivity lower than about 60:40, 70:30, 80:20, 85:15, 90:10, 91:9, 92:8, 97:3, 98:2, or 99:1. In some embodiments, at least three internucleotidic linkages have a diastereoselectivity lower than about 60:40, 70:30, 80:20, 85:15, 90:10, 91:9, 92:8, 97:3, 98:2, or 99:1. In some embodiments, at least four internucleotidic linkages have a diastereoselectivity lower than about 60:40, 70:30, 80:20, 85:15, 90:10, 91:9, 92:8, 97:3, 98:2, or 99:1. In some embodiments, at least five internucleotidic linkages have a diastereoselectivity lower than about 60:40, 70:30, 80:20, 85:15, 90:10, 91:9, 92:8, 97:3, 98:2, or 99:1. In some embodiments, each internucleotidic linkage independently has a diastereoselectivity lower than about 60:40, 70:30, 80:20, 85:15, 90:10, 91:9, 92:8, 97:3, 98:2, or 99:1. In some embodiments, a diastereoselectivity is lower than about 60:40. In some embodiments, a diastereoselectivity is lower than about 70:30. In some embodiments, a diastereoselectivity is lower than about 80:20. In some embodiments, a diastereoselectivity is lower than about 90:10. In some embodiments, a diastereoselectivity is lower than about 91:9. In some embodiments, a diastereoselectivity is lower than about 92:8. In some embodiments, a diastereoselectivity is lower than about 93:7. In some embodiments, a diastereoselectivity is lower than about 94:6. In some embodiments, a diastereoselectivity is lower than about 95:5. In some embodiments, a diastereoselectivity is lower than about 96:4. In some embodiments, a diastereoselectivity is lower than about 97:3. In some embodiments, a diastereoselectivity is lower than about 98:2. In some embodiments, a diastereoselectivity is lower than about 99:1. In some embodiments, at least one coupling has a diastereoselectivity lower than about 90:10. In some embodiments, at least two couplings have a diastereoselectivity lower than about 90:10. In some embodiments, at least three couplings have a diastereoselectivity lower than about 90:10. In some embodiments, at least four couplings have a diastereoselectivity lower than about 90:10. In some embodiments, at least five couplings have a diastereoselectivity lower than about 90:10. In some embodiments, each coupling independently has a diastereoselectivity lower than about 90:10. In some embodiments, at least one internucleotidic linkage has a diastereoselectivity lower than about 90:10. In some embodiments, at least two internucleotidic linkages have a diastereoselectivity lower than about 90:10. In some embodiments, at least three internucleotidic linkages have a diastereoselectivity lower than about 90:10. In some embodiments, at least four internucleotidic linkages have a diastereoselectivity lower than about 90:10. In some embodiments, at least five internucleotidic linkages have a diastereoselectivity lower than about 90:10. In some embodiments, each internucleotidic linkage independently has a diastereoselectivity lower than about 90:10.

In some embodiments, a chirally controlled internucleotidic linkage, such as those of oligonucleotides of chirally controlled oligonucleotide compositions, has a diastereoselectivity of 90:10 or more. In some embodiments, each chirally controlled internucleotidic linkage, such as those of oligonucleotides of chirally controlled oligonucleotide compositions, has a diastereoselectivity of 90:10 or more. In some embodiments, the selectivity is 91:9 or more. In some embodiments, the selectivity is 92:8 or more. In some embodiments, the selectivity is 97:3 or more. In some embodiments, the selectivity is 94:6 or more. In some embodiments, the selectivity is 95:5 or more. In some embodiments, the selectivity is 96:4 or more. In some embodiments, the selectivity is 97:3 or more. In some embodiments, the selectivity is 98:2 or more. In some embodiments, the selectivity is 99:1 or more.

As understood by a person having ordinary skill in the art, in some embodiments, diastereoselectivity of a coupling or a linkage can be assessed through the diastereoselectivity of a dimer formation under the same or comparable conditions, wherein the dimer has the same 5'- and 3'-nucleosides and internucleotidic linkage. For example, diastereoselectivity of the underlined coupling or linkage in WV-1092 mG*SmGmCmAmC*SA*SA*SG*SG*SG*SC*SA*SC*RA*SG*SmAmCmUmU*SmC can be assessed from coupling two G moieties under the same or comparable conditions, e.g., monomers, chiral auxiliaries, solvents, activators, temperatures, etc.

In some embodiments, the present disclosure provides chirally controlled (and/or stereochemically pure) oligonucleotide compositions comprising a first plurality of oligonucleotides defined by having:

1) a common base sequence and length;
2) a common pattern of backbone linkages; and
3) a common pattern of backbone chiral centers, which composition is a substantially pure preparation of a single oligonucleotide in that at least about 10% of the oligonucleotides in the composition have the common base sequence and length, the common pattern of backbone linkages, and the common pattern of backbone chiral centers.

In some embodiments, the present disclosure provides chirally controlled oligonucleotide composition of a first plurality of oligonucleotides in that the composition is enriched, relative to a substantially racemic preparation of the same oligonucleotides, for oligonucleotides of a single oligonucleotide type. In some embodiments, the present disclosure provides chirally controlled oligonucleotide composition of a first plurality of oligonucleotides in that the composition is enriched, relative to a substantially racemic preparation of the same oligonucleotides, for oligonucleotides of a single oligonucleotide type that share:

1) a common base sequence and length;
2) a common pattern of backbone linkages; and
3) a common pattern of backbone chiral centers.

In some embodiments, the present disclosure provides a chirally controlled oligonucleotide composition comprising a first plurality of oligonucleotides of a particular oligonucleotide type characterized by:

1) a common base sequence and length;
2) a common pattern of backbone linkages; and
3) a common pattern of backbone chiral centers;

which composition is chirally controlled in that it is enriched, relative to a substantially racemic preparation of oligonucleotides having the same base sequence and length, for oligonucleotides of the particular oligonucleotide type.

In some embodiments, oligonucleotides having a common base sequence and length, a common pattern of backbone linkages, and a common pattern of backbone chiral centers have a common pattern of backbone phosphorus modifications and a common pattern of base modifications. In some embodiments, oligonucleotides having a common base sequence and length, a common pattern of backbone linkages, and a common pattern of backbone chiral centers have a common pattern of backbone phosphorus modifications and a common pattern of nucleoside modifications. In some embodiments, oligonucleotides having a common base sequence and length, a common pattern of backbone linkages, and a common pattern of backbone chiral centers have identical structures.

In some embodiments, oligonucleotides of an oligonucleotide type have a common pattern of backbone phosphorus modifications and a common pattern of sugar modifications. In some embodiments, oligonucleotides of an oligonucleotide type have a common pattern of backbone phosphorus modifications and a common pattern of base modifications. In some embodiments, oligonucleotides of an oligonucleotide type have a common pattern of backbone phosphorus modifications and a common pattern of nucleoside modifications. In some embodiments, oligonucleotides of an oligonucleotide type are identical.

In some embodiments, a chirally controlled oligonucleotide composition is a substantially pure preparation of an oligonucleotide type in that oligonucleotides in the composition that are not of the oligonucleotide type are impurities form the preparation process of said oligonucleotide type, in some case, after certain purification procedures.

In some embodiments, at least about 20% of the oligonucleotides in the composition have a common base sequence and length, a common pattern of backbone linkages, and a common pattern of backbone chiral centers. In some embodiments, at least about 25% of the oligonucleotides in the composition have a common base sequence and length, a common pattern of backbone linkages, and a common pattern of backbone chiral centers. In some embodiments, at least about 30% of the oligonucleotides in the composition have a common base sequence and length, a common pattern of backbone linkages, and a common pattern of backbone chiral centers. In some embodiments, at least about 35% of the oligonucleotides in the composition have a common base sequence and length, a common pattern of backbone linkages, and a common pattern of backbone chiral centers. In some embodiments, at least about 40% of the oligonucleotides in the composition have a common base sequence and length, a common pattern of backbone linkages, and a common pattern of backbone chiral centers. In some embodiments, at least about 45% of the oligonucleotides in the composition have a common base sequence and length, a common pattern of backbone linkages, and a common pattern of backbone chiral centers. In some embodiments, at least about 50% of the oligonucleotides in the composition have a common base sequence and length, a common pattern of backbone linkages, and a common pattern of backbone chiral centers. In some embodiments, at least about 55% of the oligonucleotides in the composition have a common base sequence and length, a common pattern of backbone linkages, and a common pattern of backbone chiral centers. In some embodiments, at least about 60% of the oligonucleotides in the composition have a common base sequence and length, a common pattern of backbone linkages, and a common pattern of backbone chiral centers. In some embodiments, at least about 65% of the oligonucleotides in the composition have a common base sequence and length, a common pattern of backbone linkages, and a common pattern of backbone chiral centers. In some embodiments, at least about 70% of the oligonucleotides in the composition have a common base sequence and length, a common pattern of backbone linkages, and a common pattern of backbone chiral centers. In some embodiments, at least about 75% of the oligonucleotides in the composition have a common base sequence and length, a common pattern of backbone linkages, and a common pattern of backbone chiral centers. In some embodiments, at least about 80% of the oligonucleotides in the composition have a common base sequence and length, a common pattern of backbone linkages, and a common pattern of backbone chiral centers. In some embodiments, at least about 85% of the oligonucleotides in the composition have a common base sequence and length, a common pattern of backbone linkages, and a common pattern of backbone chiral centers. In some embodiments, at least about 90% of the oligonucleotides in the composition have a common base sequence and length, a common pattern of backbone linkages, and a common pattern of backbone chiral centers. In some embodiments, at least about 92% of the oligonucleotides in the composition have a common base sequence and length, a common pattern of backbone linkages, and a common pattern of backbone chiral centers. In some embodiments, at least about 94% of the oligonucleotides in the composition have a common base sequence and length, a common pattern of backbone linkages, and a common pattern of backbone chiral centers. In some embodiments, at least about 95% of the oligonucleotides in the composition have a common base sequence and length, a common pattern of backbone linkages, and a common pattern of backbone chiral centers. In some embodiments, at least about 91%, 92%, 93%, 94%, 95%, 96%, 97%, 98%, or 99% of the oligonucleotides in the composition have a common base sequence and length, a common pattern of backbone linkages, and a common pattern of backbone chiral centers. In some embodiments, greater than about 99% of the oligonucleotides in the composition have a common base sequence and length, a common pattern of backbone linkages, and a common pattern of backbone chiral centers. In some embodiments, purity of a chirally controlled oligonucleotide composition of an oligonucleotide can be expressed as the percentage of oligonucleotides in the composition that have a common base sequence and length, a common pattern of backbone linkages, and a common pattern of backbone chiral centers.

In some embodiments, oligonucleotides having a common base sequence and length, a common pattern of backbone linkages, and a common pattern of backbone chiral centers have a common pattern of backbone phosphorus modifications. In some embodiments, oligonucleotides having a common base sequence and length, a common pattern of backbone linkages, and a common pattern of backbone chiral centers have a common pattern of backbone phosphorus modifications and a common pattern of nucleoside modifications. In some embodiments, oligonucleotides having a common base sequence and length, a common pattern of backbone linkages, and a common pattern of backbone chiral centers have a common pattern of backbone phosphorus modifications and a common pattern of sugar modifications. In some embodiments, oligonucleotides having a common base sequence and length, a common pattern of backbone linkages, and a common pattern of backbone chiral centers have a common pattern of backbone phosphorus modifications and a common pattern of base modifications. In some embodiments, oligonucleotides having a common base sequence and length, a common pattern of backbone linkages, and a common pattern of backbone chiral centers have a common pattern of backbone phosphorus modifications and a common pattern of nucleoside modifications. In some embodiments, oligonucleotides having a common base sequence and length, a common pattern of backbone linkages, and a common pattern of backbone chiral centers are identical.

In some embodiments, oligonucleotides in provided compositions have a common pattern of backbone phosphorus modifications. In some embodiments, a common base sequence is a base sequence of an oligonucleotide type. In some embodiments, a provided composition is an oligonucleotide composition that is chirally controlled in that the composition contains a predetermined level of a first plurality of oligonucleotides of an individual oligonucleotide type, wherein an oligonucleotide type is defined by:

1) base sequence;
2) pattern of backbone linkages;
3) pattern of backbone chiral centers; and
4) pattern of backbone phosphorus modifications.

As noted above and understood in the art, in some embodiments, base sequence of an oligonucleotide may refer to the identity and/or modification status of nucleoside residues (e.g., of sugar and/or base components, relative to standard naturally occurring nucleotides such as adenine, cytosine, guanosine, thymine, and uracil) in the oligonucleotide and/or to the hybridization character (i.e., the ability to hybridize with particular complementary residues) of such residues.

In some embodiments, a particular oligonucleotide type may be defined by 1A) base identity;
1B) pattern of base modification;
1C) pattern of sugar modification;
2) pattern of backbone linkages;
3) pattern of backbone chiral centers; and
4) pattern of backbone phosphorus modifications.

Thus, in some embodiments, oligonucleotides of a particular type may share identical bases but differ in their pattern of base modifications and/or sugar modifications. In some embodiments, oligonucleotides of a particular type may share identical bases and pattern of base modifications (including, e.g., absence of base modification), but differ in pattern of sugar modifications.

In some embodiments, oligonucleotides of a particular type are identical in that they have the same base sequence (including length), the same pattern of chemical modifications to sugar and base moieties, the same pattern of backbone linkages (e.g., pattern of natural phosphate linkages, phosphorothioate linkages, phosphorothioate triester linkages, and combinations thereof), the same pattern of backbone chiral centers (e.g., pattern of stereochemistry (Rp/Sp) of chiral internucleotidic linkages), and the same pattern of backbone phosphorus modifications (e.g., pattern of modifications on the internucleotidic phosphorus atom, such as $—S^-$, and $-L-R^1$ of formula I).

In some embodiments, purity of a chirally controlled oligonucleotide composition of an oligonucleotide type is expressed as the percentage of oligonucleotides in the composition that are of the oligonucleotide type. In some embodiments, at least about 10% of the oligonucleotides in a chirally controlled oligonucleotide composition are of the same oligonucleotide type. In some embodiments, at least about 20% of the oligonucleotides in a chirally controlled oligonucleotide composition are of the same oligonucleotide type. In some embodiments, at least about 30% of the oligonucleotides in a chirally controlled oligonucleotide composition are of the same oligonucleotide type. In some embodiments, at least about 40% of the oligonucleotides in a chirally controlled oligonucleotide composition are of the same oligonucleotide type. In some embodiments, at least about 50% of the oligonucleotides in a chirally controlled oligonucleotide composition are of the same oligonucleotide type. In some embodiments, at least about 60% of the oligonucleotides in a chirally controlled oligonucleotide composition are of the same oligonucleotide type. In some embodiments, at least about 70% of the oligonucleotides in a chirally controlled oligonucleotide composition are of the same oligonucleotide type. In some embodiments, at least about 80% of the oligonucleotides in a chirally controlled oligonucleotide composition are of the same oligonucleotide type. In some embodiments, at least about 90% of the oligonucleotides in a chirally controlled oligonucleotide composition are of the same oligonucleotide type. In some embodiments, at least about 92% of the oligonucleotides in a chirally controlled oligonucleotide composition are of the same oligonucleotide type. In some embodiments, at least about 94% of the oligonucleotides in a chirally controlled oligonucleotide composition are of the same oligonucleotide type. In some embodiments, at least about 95% of the oligonucleotides in a chirally controlled oligonucleotide composition are of the same oligonucleotide type. In some embodiments, at least about 96% of the oligonucleotides in a chirally controlled oligonucleotide composition are of the same oligonucleotide type. In some embodiments, at least about 97% of the oligonucleotides in a chirally controlled oligonucleotide composition are of the same oligonucleotide type. In some embodiments, at least about 98% of the oligonucleotides in a chirally controlled oligonucleotide composition are of the same oligonucleotide type. In some embodiments, at least about 99% of the oligonucleotides in a chirally controlled oligonucleotide composition are of the same oligonucleotide type.

In some embodiments, purity of a chirally controlled oligonucleotide composition can be controlled by stereoselectivity of each coupling step in its preparation process. In some embodiments, a coupling step has a stereoselectivity (e.g., diastereoselectivity) of 60% (60% of the new internucleotidic linkage formed from the coupling step has the intended stereochemistry). After such a coupling step, the new internucleotidic linkage formed may be referred to have a 60% purity. In some embodiments, each coupling step has a stereoselectivity of at least 60%. In some embodiments, each coupling step has a stereoselectivity of at least 70%. In some embodiments, each coupling step has a stereoselectivity of at least 80%. In some embodiments, each coupling step has a stereoselectivity of at least 85%. In some embodiments, each coupling step has a stereoselectivity of at least 90%. In some embodiments, each coupling step has a stereoselectivity of at least 91%. In some embodiments, each coupling step has a stereoselectivity of at least 92%. In some embodiments, each coupling step has a stereoselectivity of at least 93%. In some embodiments, each coupling step has a stereoselectivity of at least 94%. In some embodiments, each coupling step has a stereoselectivity of at least 95%. In some embodiments, each coupling step has a stereoselectivity of at least 96%. In some embodiments, each coupling step has a stereoselectivity of at least 97%. In some embodiments, each coupling step has a stereoselectivity of at least 98%. In some embodiments, each coupling step has a stereoselectivity of at least 99%. In some embodiments, each coupling step has a stereoselectivity of at least 99.5%. In some embodiments, each coupling step has a stereoselectivity of virtually 100%. In some embodiments, a coupling step has a stereoselectivity of virtually 100% in that all detectable product from the coupling step by an analytical method (e.g., NMR, HPLC, etc) has the intended stereoselectivity. In some embodiments, stereoselectivity of a chiral internucleotidic linkage in an oligonucleotide may be measured through a model reaction, e.g. formation of a dimer under essentially the same or comparable conditions wherein the dimer has the same internucleotidic linkage as the chiral internucleotidic linkage, the 5'-nucleoside of the dimer is the same as the nucleoside to the 5'-end of the chiral internucleotidic linkage, and the 3'-nucleoside of the dimer is the same as the nucleoside to the 3'-end of the chiral internucleotidic linkage (e.g., for fU*SfU*SfC*SfU, through the dimer of fU*SfC). As appreciated by a person having ordinary skill in the art, percentage of oligonucleotides of a particular type having n internucleotidic linkages in a preparation may be calculated as $SE^1*SE^2*SE^3*\ldots SE^n$, wherein $SE^1$, $SE^2$, $SE^3$, . . . , $SE^n$ is independently the stereoselectivity of the 1st, 2nd, 3rd, . . . , and nth chiral internucleotidic linkage. I In some embodiments, in provided compositions, at least 0.5%, 1%, 2%, 3%, 4%, 5%, 6%, 7%, 8%, 9%, 10%, 20%, 30%, 40%, 50%, 60%, 70%, 75%, 80%, 81%, 82%, 83%, 84%, 85%, 86%, 87%, 88%, 89%, 90%, 91%, 92%, 93%, 94%, 95%, 96%, 97%, 97% or 99% of oligonucleotides that have the base sequence of a particular oligonucleotide type (defined by 1) base sequence; 2) pattern of backbone linkages; 3) pattern of backbone chiral centers; and 4) pattern of backbone phosphorus modifications) are oligonucleotides of the particular oligonucleotide type. In some embodiments, at least 0.5%, 1%, 2%, 3%, 4%, 5%, 6%, 7%, 8%, 9%, 10%, 20%, 30%, 40%, 50%, 60%, 70%, 75%, 80%, 81%, 82%, 83%, 84%, 85%, 86%, 87%, 88%, 89%, 90%, 91%, 92%, 93%, 94%, 95%, 96%, 97%, 97% or 99% of oligonucleotides that have the base sequence, the pattern of backbone linkages, and the pattern of backbone phosphorus modifications of a particular oligonucleotide type are oligonucleotides of the particular oligonucleotide type. In some embodiments, the percentage is at least 0.5%. In some embodiments, the percentage is at least 1%. In some embodiments, the percentage is at least 2%. In some embodiments, the percentage is at least 3%. In some embodiments, the percentage is at least 4%. In some embodiments, the percentage is at least 5%. In some embodiments, the percentage is at least 6%. In some embodiments, the percentage is at least 7%. In some embodiments, the percentage is at least 8%. In some embodiments, the percentage is at least 9%. In some embodiments, the percentage is at least 10%. In some embodiments, the percentage is at least 20%. In some embodiments, the percentage is at least 30%. In some embodiments, the percentage is at least 40%. In some embodiments, the percentage is at least 50%. In some embodiments, the percentage is at least 60%. In some embodiments, the percentage is at least 70%. In some embodiments, the percentage is at least 75%. In some embodiments, the percentage is at least 80%. In some embodiments, the percentage is at least 81%. In some embodiments, the percentage is at least 82%. In some embodiments, the percentage is at least 83%. In some embodiments, the percentage is at least 84%. In some embodiments, the percentage is at least 85%. In some embodiments, the percentage is at least 86%. In some embodiments, the percentage is at least 87%. In some embodiments, the percentage is at least 88%. In some embodiments, the percentage is at least 89%. In some embodiments, the percentage is at least 90%. In some embodiments, the percentage is at least 91%. In some embodiments, the percentage is at least 92%. In some embodiments, the percentage is at least 93%. In some embodiments, the percentage is at least 94%. In some embodiments, the percentage is at least 95%. In some embodiments, the percentage is at least 96%. In some embodiments, the percentage is at least 97%. In some embodiments, the percentage is at least 98%. In some embodiments, the percentage is at least 99%.

In some embodiments, oligonucleotides of a particular type in a chirally controlled oligonucleotide composition is enriched at least 5 fold (oligonucleotides of the particular type have a fraction of $5*(\frac{1}{2}^n)$ of oligonucleotides that have the base sequence, the pattern of backbone linkages, and the pattern of backbone phosphorus modifications of the particular oligonucleotide type, wherein n is the number of chiral internucleotidic linkages; or oligonucleotides that have the base sequence, the pattern of backbone linkages, and the pattern of backbone phosphorus modifications of the particular oligonucleotide type but are not of the particular oligonucleotide type are no more than $[1-(\frac{1}{2}^n)]/5$ of oligonucleotides that have the base sequence, the pattern of backbone linkages, and the pattern of backbone phosphorus modifications of the particular oligonucleotide type) compared to a stereorandom preparation of the oligonucleotides (oligonucleotides of the particular type are typically considered to have a fraction of $\frac{1}{2}^n$ of oligonucleotides that have the base sequence, the pattern of backbone linkages, and the pattern of backbone phosphorus modifications of the particular oligonucleotide type, wherein n is the number of chiral internucleotidic linkages, and oligonucleotides that have the base sequence, the pattern of backbone linkages, and the pattern of backbone phosphorus modifications of the particular oligonucleotide type but are not of the particular oligonucleotide type are typically considered to have a fraction of $[1-(\frac{1}{2}^n)]$ of oligonucleotides that have the base sequence, the pattern of backbone linkages, and the pattern of backbone phosphorus modifications of the particular oligonucleotide type). In some embodiments, the enrichment is at least 20 fold. In some embodiments, the enrichment is at least 30 fold. In some embodiments, the enrichment is at least 40 fold. In some embodiments, the enrichment is at least 50 fold. In some embodiments, the enrichment is at least 60 fold. In some embodiments, the enrichment is at least 70 fold. In some embodiments, the enrichment is at least 80 fold. In some embodiments, the enrichment is at least 90 fold. In some embodiments, the enrichment is at least 100 fold. In some embodiments, the enrichment is at least 200 fold. In some embodiments, the enrichment is at least 300 fold. In some embodiments, the enrichment is at least 400 fold. In some embodiments, the enrichment is at least 500 fold. In some embodiments, the enrichment is at least 600 fold. In some embodiments, the enrichment is at least 700 fold. In some embodiments, the enrichment is at least 800 fold. In some embodiments, the enrichment is at least 900 fold. In some embodiments, the enrichment is at least 1,000 fold. In some embodiments, the enrichment is at least 2,000 fold. In some embodiments, the enrichment is at least 4,000 fold. In some embodiments, the enrichment is at least 8,000 fold. In some embodiments, the enrichment is at least 10,000 fold. In some embodiments, the enrichment is at least 20,000 fold. In some embodiments, the enrichment is at least $(1.5)^n$. In some embodiments, the enrichment is at least $(1.6)^n$. In some embodiments, the enrichment is at least $(1.7)^n$. In some embodiments, the enrichment is at least $(1.1)^n$. In some embodiments, the enrichment is at least $(1.8)^n$. In some embodiments, the enrichment is at least $(1.9)^n$. In some embodiments, the enrichment is at least $2^n$. In some embodiments, the enrichment is at least $3^n$. In some embodiments, the enrichment is at least $4^n$. In some embodiments, the enrichment is at least $5^n$. In some embodiments, the enrichment is at least $6^n$. In some embodiments, the enrichment is at least $7^n$. In some embodiments, the enrichment is at least $8^n$. In some embodiments, the enrichment is at least $9^n$. In some embodiments, the enrichment is at least $10^n$. In some embodiments, the enrichment is at least $15^n$. In some embodiments, the enrichment is at least $20^n$. In some embodiments, the enrichment is at least $25^n$. In some embodiments, the enrichment is at least $30^n$. In some embodiments, the enrichment is at least $40^n$. In some embodiments, the enrichment is at least $50^n$. In some embodiments, the enrichment is at least $100^n$. In some embodiments, enrichment is measured by increase of the fraction of oligonucleotides of the particular oligonucleotide type in oligonucleotides that have the base sequence, the pattern of backbone linkages, and the pattern of backbone phosphorus modifications of the particular oligonucleotide type. In some embodiments, an enrichment is measured by decrease of the fraction of oligonucleotides that have the base sequence, the pattern of backbone linkages, and the pattern of backbone phosphorus modifications of the particular oligonucleotide type but are not of the particular oligonucleotide type in oligonucleotides that have the base sequence, the pattern of backbone linkages, and the pattern of backbone phosphorus modifications of the particular oligonucleotide type.

Among other things, the present disclosure recognizes that combinations of oligonucleotide structural elements (e.g., patterns of chemical modifications, backbone linkages, backbone chiral centers, and/or backbone phosphorus modifications) can provide surprisingly improved properties such as bioactivities.

In some embodiments, the present disclosure provides an oligonucleotide composition comprising a predetermined level of a first plurality of oligonucleotides which comprise one or more wing regions and a common core region, wherein: each wing region independently has a length of two or more bases, and independently and optionally comprises one or more chiral internucleotidic linkages; the core region independently has a length of two or more bases, and independently comprises one or more chiral internucleotidic linkages, and the common core region has:

1) a common base sequence and length;
2) a common pattern of backbone linkages; and
3) a common pattern of backbone chiral centers, wherein the lipids are optionally and independently conjugated to one or more oligonucleotides of the plurality.

In some embodiments, a wing region comprises a structural feature that is not in a core region. In some embodiments, a wing and core can be defined by any structural elements, e.g., base modifications (e.g., methylated/non-methylated, methylation at position 1/methylation at position 2, etc.), sugar modifications (e.g., modified/non-modified, 2'-modification/another type of modification, one type of 2'-modification/another type of 2'-modification, etc.), backbone linkage types (e.g., phosphate/phosphorothioate, phosphorothioate/substituted phosphorothioate, etc.), backbone chiral center stereochemistry (e.g., all Sp/all Rp, (SpRp) repeats/all Rp, etc.), backbone phosphorus modification types (e.g., s1/s2, s1/s3, etc.), etc.

In some embodiments, a wing and core is defined by nucleoside modifications, wherein a wing comprises a nucleoside modification that the core region does not have. In some embodiments, a wing and core is defined by sugar modifications, wherein a wing comprises a sugar modification that the core region does not have. In some embodiments, a sugar modification is a 2'-modification. In some embodiments, a sugar modification is $2'\text{-OR}^1$. In some embodiments, a sugar modification is 2'-MOE. In some embodiments, a sugar modification is 2'-OMe. Additionally example sugar modifications are described in the present disclosure. In some embodiments, a wing and core is defined by internucleotidic linkages, wherein a wing comprises a internucleotidic linkage type (e.g., natural phosphate linkage, a type of modified internucleotidic linkage, etc.) that the core region does not have. In some embodiments, a wing and core is defined by internucleotidic linkages, wherein a wing has a pattern of backbone linkage that is different from that of the core.

In some embodiments, oligonucleotides in provided compositions have a wing-core structure (hemimer). In some embodiments, oligonucleotides in provided compositions have a wing-core structure of nucleoside modifications. In some embodiments, oligonucleotides in provided compositions have a core-wing structure (another type of hemimer). In some embodiments, oligonucleotides in provided compositions have a core-wing structure of nucleoside modifications. In some embodiments, oligonucleotides in provided compositions have a wing-core-wing structure (gapmer). In some embodiments, oligonucleotides in provided compositions have a wing-core-wing structure of nucleoside modifications. In some embodiments, a wing and core is defined by modifications of the sugar moieties. In some embodiments, a wing and core is defined by modifications of the base moieties. In some embodiments, each sugar moiety in the wing region has the same 2'-modification which is not found in the core region. In some embodiments, each sugar moiety in the wing region has the same 2'-modification which is different than any sugar modifications in the core region. In some embodiments, a core region has no sugar modification. In some embodiments, each sugar moiety in the wing region has the same 2'-modification, and the core region has no 2'-modifications. In some embodiments, when two or more wings are present, each wing is defined by its own modifications. In some embodiments, each wing has its own characteristic sugar modification. In some embodiments, each wing has the same characteristic sugar modification differentiating it from a core. In some embodiments, each wing sugar moiety has the same modification. In some embodiments, each wing sugar moiety has the same 2'-modification. In some embodiments, each sugar moiety in a wing region has the same 2'-modification, yet the common 2'-modification in a first wing region can either be the same as or different from the common 2'-modification in a second wing region. In some embodiments, each sugar moiety in a wing region has the same 2'-modification, and the common 2'-modification in a first wing region is the same as the common 2'-modification in a second wing region. In some embodiments, each sugar moiety in a wing region has the same 2'-modification, and the common 2'-modification in a first wing region is different from the common 2'-modification in a second wing region.

In some embodiments, provided chirally controlled (and/or stereochemically pure) preparations are antisense oligonucleotides (e.g., chiromersen). In some embodiments, provided chirally controlled (and/or stereochemically pure) preparations are siRNA oligonucleotides. In some embodiments, a provided chirally controlled oligonucleotide composition is of oligonucleotides that can be antisense oligonucleotide, antagomir, microRNA, pre-microRNs, antimir, supermir, ribozyme, UI adaptor, RNA activator, RNAi agent, decoy oligonucleotide, triplex forming oligonucleotide, aptamer or adjuvant. In some embodiments, a chirally controlled oligonucleotide composition is of antisense oligonucleotides. In some embodiments, a chirally controlled oligonucleotide composition is of antagomir oligonucleotides. In some embodiments, a chirally controlled oligonucleotide composition is of microRNA oligonucleotides. In some embodiments, a chirally controlled oligonucleotide composition is of pre-microRNA oligonucleotides. In some embodiments, a chirally controlled oligonucleotide composition is of antimir oligonucleotides. In some embodiments, a chirally controlled oligonucleotide composition is of supermir oligonucleotides. In some embodiments, a chirally controlled oligonucleotide composition is of ribozyme oligonucleotides. In some embodiments, a chirally controlled oligonucleotide composition is of UI adaptor oligonucleotides. In some embodiments, a chirally controlled oligonucleotide composition is of RNA activator oligonucleotides. In some embodiments, a chirally controlled oligonucleotide composition is of RNAi agent oligonucleotides. In some embodiments, a chirally controlled oligonucleotide composition is of decoy oligonucleotides. In some embodiments, a chirally controlled oligonucleotide composition is of triplex forming oligonucleotides. In some embodiments, a chirally controlled oligonucleotide composition is of aptamer oligonucleotides. In some embodiments, a chirally controlled oligonucleotide composition is of adjuvant oligonucleotides.

In some embodiments, provided chirally controlled (and/or stereochemically pure) preparations are of oligonucleotides that include one or more modified backbone linkages, bases, and/or sugars.

In some embodiments, a provided oligonucleotide comprises one or more chiral, modified phosphate linkages. In some embodiments, a provided oligonucleotide comprises two or more chiral, modified phosphate linkages. In some embodiments, a provided oligonucleotide comprises three or more chiral, modified phosphate linkages. In some embodiments, a provided oligonucleotide comprises four or more chiral, modified phosphate linkages. In some embodiments, a provided oligonucleotide comprises five or more chiral, modified phosphate linkages. In some embodiments, a provided oligonucleotide comprises 1, 2, 3, 4, 5, 6, 7, 8, 9, 10, 11, 12, 13, 14, 15, 16, 17, 18, 19, 20, 21, 22, 23, 24, or 25 chiral, modified phosphate linkages. In some embodiments, a provided oligonucleotide type comprises 5 or more chiral, modified phosphate linkages. In some embodiments, a provided oligonucleotide type comprises 6 or more chiral, modified phosphate linkages. In some embodiments, a provided oligonucleotide type comprises 7 or more chiral, modified phosphate linkages. In some embodiments, a provided oligonucleotide type comprises 8 or more chiral, modified phosphate linkages. In some embodiments, a provided oligonucleotide type comprises 9 or more chiral, modified phosphate linkages. In some embodiments, a provided oligonucleotide type comprises 10 or more chiral, modified phosphate linkages. In some embodiments, a provided oligonucleotide type comprises 11 or more chiral, modified phosphate linkages. In some embodiments, a provided oligonucleotide type comprises 12 or more chiral, modified phosphate linkages. In some embodiments, a provided oligonucleotide type comprises 13 or more chiral, modified phosphate linkages. In some embodiments, a provided oligonucleotide type comprises 14 or more chiral, modified phosphate linkages. In some embodiments, a provided oligonucleotide type comprises 15 or more chiral, modified phosphate linkages. In some embodiments, a provided oligonucleotide type comprises 16 or more chiral, modified phosphate linkages. In some embodiments, a provided oligonucleotide type comprises 17 or more chiral, modified phosphate linkages. In some embodiments, a provided oligonucleotide type comprises 18 or more chiral, modified phosphate linkages. In some embodiments, a provided oligonucleotide type comprises 19 or more chiral, modified phosphate linkages. In some embodiments, a provided oligonucleotide type comprises 20 or more chiral, modified phosphate linkages. In some embodiments, a provided oligonucleotide type comprises 21 or more chiral, modified phosphate linkages. In some embodiments, a provided oligonucleotide type comprises 22 or more chiral, modified phosphate linkages. In some embodiments, a provided oligonucleotide type comprises 23 or more chiral, modified phosphate linkages. In some embodiments, a provided oligonucleotide type comprises 24 or more chiral, modified phosphate linkages. In some embodiments, a provided oligonucleotide type comprises 25 or more chiral, modified phosphate linkages.

In some embodiments, a provided oligonucleotide comprises at least 5%, 10%, 15%, 20%, 25%, 30%, 35%, 40%, 45%, 50%, 55%, 60%, 65%, 70%, 75%, 80%, 85%, 90%, 95%, or 100% chiral, modified phosphate linkages. Example chiral, modified phosphate linkages are described above and herein. In some embodiments, a provided oligonucleotide comprises at least 5%, 10%, 15%, 20%, 25%, 30%, 35%, 40%, 45%, 50%, 55%, 60%, 65%, 70%, 75%, 80%, 85%, 90%, 95%, or 100% chiral, modified phosphate linkages in the Sp configuration.

In some embodiments, provided chirally controlled (and/or stereochemically pure) preparations are of a stereochemical purity of greater than about 80%. In some embodiments, provided chirally controlled (and/or stereochemically pure) preparations are of a stereochemical purity of greater than about 85%. In some embodiments, provided chirally controlled (and/or stereochemically pure) preparations are of a stereochemical purity of greater than about 90%. In some embodiments, provided chirally controlled (and/or stereochemically pure) preparations are of a stereochemical purity of greater than about 91%. In some embodiments, provided chirally controlled (and/or stereochemically pure) preparations are of a stereochemical purity of greater than about 92%. In some embodiments, provided chirally controlled (and/or stereochemically pure) preparations are of a stereochemical purity of greater than about 93%. In some embodiments, provided chirally controlled (and/or stereochemically pure) preparations are of a stereochemical purity of greater than about 94%. In some embodiments, provided chirally controlled (and/or stereochemically pure) preparations are of a stereochemical purity of greater than about 95%. In some embodiments, provided chirally controlled (and/or stereochemically pure) preparations are of a stereochemical purity of greater than about 96%. In some embodiments, provided chirally controlled (and/or stereochemically pure) preparations are of a stereochemical purity of greater than about 97%. In some embodiments, provided chirally controlled (and/or stereochemically pure) preparations are of a stereochemical purity of greater than about 98%. In some embodiments, provided chirally controlled (and/or stereochemically pure) preparations are of a stereochemical purity of greater than about 99%.

In some embodiments, such a provided purity can be of one or more chiral internucleotidic linkage is a composition is partially chirally controlled.

In some embodiments, a chiral, modified phosphate linkage is a chiral phosphorothioate linkage, i.e., phosphorothioate internucleotidic linkage. In some embodiments, a provided oligonucleotide comprises at least 5%, 10%, 15%, 20%, 25%, 30%, 35%, 40%, 45%, 50%, 55%, 60%, 65%, 70%, 75%, 80%, 85%, 90%, 95%, or 100% chiral phosphorothioate internucleotidic linkages. In some embodiments, all chiral, modified phosphate linkages are chiral phosphorothioate internucleotidic linkages. In some embodiments, at least about 10, 20, 30, 40, 50, 60, 70, 80, or 90% chiral phosphorothioate internucleotidic linkages of a provided oligonucleotide are of the Sp conformation. In some embodiments, at least about 10% chiral phosphorothioate internucleotidic linkages of a provided oligonucleotide are of the Sp conformation. In some embodiments, at least about 20% chiral phosphorothioate internucleotidic linkages of a provided oligonucleotide are of the Sp conformation. In some embodiments, at least about 30% chiral phosphorothioate internucleotidic linkages of a provided oligonucleotide are of the Sp conformation. In some embodiments, at least about 40% chiral phosphorothioate internucleotidic linkages of a provided oligonucleotide are of the Sp conformation. In some embodiments, at least about 50% chiral phosphorothioate internucleotidic linkages of a provided oligonucleotide are of the Sp conformation. In some embodiments, at least about 60% chiral phosphorothioate internucleotidic linkages of a provided oligonucleotide are of the Sp conformation. In some embodiments, at least about 70% chiral phosphorothioate internucleotidic linkages of a provided oligonucleotide are of the Sp conformation. In some embodiments, at least about 80% chiral phosphorothioate internucleotidic linkages of a provided oligonucleotide are of the Sp conformation. In some embodiments, at least about 90% chiral phosphorothioate internucleotidic linkages of a provided oligonucleotide are of the Sp conformation. In some embodiments, at least about 95% chiral phosphorothioate internucleotidic linkages of a provided oligonucleotide are of the Sp conformation.

In some embodiments, at least about 10, 20, 30, 40, 50, 60, 70, 80, or 90% chiral phosphorothioate internucleotidic linkages of a provided oligonucleotide are of the Rp conformation. In some embodiments, at least about 10% chiral phosphorothioate internucleotidic linkages of a provided oligonucleotide are of the Rp conformation. In some embodiments, at least about 20% chiral phosphorothioate internucleotidic linkages of a provided oligonucleotide are of the Rp conformation. In some embodiments, at least about 30% chiral phosphorothioate internucleotidic linkages of a provided oligonucleotide are of the Rp conformation. In some embodiments, at least about 40% chiral phosphorothioate internucleotidic linkages of a provided oligonucleotide are of the Rp conformation. In some embodiments, at least about 50% chiral phosphorothioate internucleotidic linkages of a provided oligonucleotide are of the Rp conformation. In some embodiments, at least about 60% chiral phosphorothioate internucleotidic linkages of a provided oligonucleotide are of the Rp conformation. In some embodiments, at least about 70% chiral phosphorothioate internucleotidic linkages of a provided oligonucleotide are of the Rp conformation. In some embodiments, at least about 80% chiral phosphorothioate internucleotidic linkages of a provided oligonucleotide are of the Rp conformation. In some embodiments, at least about 90% chiral phosphorothioate internucleotidic linkages of a provided oligonucleotide are of the Rp conformation. In some embodiments, at least about 95% chiral phosphorothioate internucleotidic linkages of a provided oligonucleotide are of the Rp conformation.

In some embodiments, less than about 10, 20, 30, 40, 50, 60, 70, 80, or 90% chiral phosphorothioate internucleotidic linkages of a provided oligonucleotide are of the Rp conformation. In some embodiments, less than about 10% chiral phosphorothioate internucleotidic linkages of a provided oligonucleotide are of the Rp conformation. In some embodiments, less than about 20% chiral phosphorothioate internucleotidic linkages of a provided oligonucleotide are of the Rp conformation. In some embodiments, less than about 30% chiral phosphorothioate internucleotidic linkages of a provided oligonucleotide are of the Rp conformation. In some embodiments, less than about 40% chiral phosphorothioate internucleotidic linkages of a provided oligonucleotide are of the Rp conformation. In some embodiments, less than about 50% chiral phosphorothioate internucleotidic linkages of a provided oligonucleotide are of the Rp conformation. In some embodiments, less than about 60% chiral phosphorothioate internucleotidic linkages of a provided oligonucleotide are of the Rp conformation. In some embodiments, less than about 70% chiral phosphorothioate internucleotidic linkages of a provided oligonucleotide are of the Rp conformation. In some embodiments, less than about 80% chiral phosphorothioate internucleotidic linkages of a provided oligonucleotide are of the Rp conformation. In some embodiments, less than about 90% chiral phosphorothioate internucleotidic linkages of a provided oligonucleotide are of the Rp conformation. In some embodiments, less than about 95% chiral phosphorothioate internucleotidic linkages of a provided oligonucleotide are of the Rp conformation. In some embodiments, a provided oligonucleotide has only one Rp chiral phosphorothioate internucleotidic linkages. In some embodiments, a provided oligonucleotide has only one Rp chiral phosphorothioate internucleotidic linkages, wherein all internucleotide linkages are chiral phosphorothioate internucleotidic linkages.

In some embodiments, a chiral phosphorothioate internucleotidic linkage is a chiral phosphorothioate diester linkage. In some embodiments, each chiral phosphorothioate internucleotidic linkage is independently a chiral phosphorothioate diester linkage. In some embodiments, each internucleotidic linkage is independently a chiral phosphorothioate diester linkage. In some embodiments, each internucleotidic linkage is independently a chiral phosphorothioate diester linkage, and only one is Rp.

In some embodiments, provided chirally controlled (and/or stereochemically pure) preparations are of oligonucleotides that contain one or more modified bases. In some embodiments, provided chirally controlled (and/or stereochemically pure) preparations are of oligonucleotides that contain no modified bases. Example modified bases are described above and herein.

In some embodiments, oligonucleotides of provided compositions comprise at least 2, 3, 4, 5, 6, 7, 8, 9 or 10 natural phosphate linkages. In some embodiments, oligonucleotides of provided compositions comprise at least one natural phosphate linkage. In some embodiments, oligonucleotides of provided compositions comprise at least two natural phosphate linkages. In some embodiments, oligonucleotides of provided compositions comprise at least three natural phosphate linkages. In some embodiments, oligonucleotides of provided compositions comprise at least four natural phosphate linkages. In some embodiments, oligonucleotides of provided compositions comprise at least five natural phosphate linkages. In some embodiments, oligonucleotides of provided compositions comprise at least six natural phosphate linkages. In some embodiments, oligonucleotides of provided compositions comprise at least seven natural phosphate linkages. In some embodiments, oligonucleotides of provided compositions comprise at least eight natural phosphate linkages. In some embodiments, oligonucleotides of provided compositions comprise at least nine natural phosphate linkages. In some embodiments, oligonucleotides of provided compositions comprise at least ten natural phosphate linkages.

In some embodiments, oligonucleotides of provided compositions comprise 2, 3, 4, 5, 6, 7, 8, 9 or 10 natural phosphate linkages. In some embodiments, oligonucleotides of provided compositions comprise one natural phosphate linkage. In some embodiments, oligonucleotides of provided compositions comprise two natural phosphate linkages. In some embodiments, oligonucleotides of provided compositions comprise three natural phosphate linkages. In some embodiments, oligonucleotides of provided compositions comprise four natural phosphate linkages. In some embodiments, oligonucleotides of provided compositions comprise five natural phosphate linkages. In some embodiments, oligonucleotides of provided compositions comprise six natural phosphate linkages. In some embodiments, oligonucleotides of provided compositions comprise seven natural phosphate linkages. In some embodiments, oligonucleotides of provided compositions comprise eight natural phosphate linkages. In some embodiments, oligonucleotides of provided compositions comprise nine natural phosphate linkages. In some embodiments, oligonucleotides of provided compositions comprise ten natural phosphate linkages.

In some embodiments, oligonucleotides of provided compositions comprise at least 2, 3, 4, 5, 6, 7, 8, 9 or 10 consecutive natural phosphate linkages. In some embodiments, oligonucleotides of provided compositions comprise at least two consecutive natural phosphate linkages. In some embodiments, oligonucleotides of provided compositions comprise at least three consecutive natural phosphate linkages. In some embodiments, oligonucleotides of provided compositions comprise at least four consecutive natural phosphate linkages. In some embodiments, oligonucleotides of provided compositions comprise at least five consecutive natural phosphate linkages. In some embodiments, oligonucleotides of provided compositions comprise at least six consecutive natural phosphate linkages. In some embodiments, oligonucleotides of provided compositions comprise at least seven consecutive natural phosphate linkages. In some embodiments, oligonucleotides of provided compositions comprise at least eight consecutive natural phosphate linkages. In some embodiments, oligonucleotides of provided compositions comprise at least nine consecutive natural phosphate linkages. In some embodiments, oligonucleotides of provided compositions comprise at least ten consecutive natural phosphate linkages.

In some embodiments, oligonucleotides of provided compositions comprise 2, 3, 4, 5, 6, 7, 8, 9 or 10 consecutive natural phosphate linkages. In some embodiments, oligonucleotides of provided compositions comprise two consecutive natural phosphate linkages. In some embodiments, oligonucleotides of provided compositions comprise three consecutive natural phosphate linkages. In some embodiments, oligonucleotides of provided compositions comprise four consecutive natural phosphate linkages. In some embodiments, oligonucleotides of provided compositions comprise five consecutive natural phosphate linkages. In some embodiments, oligonucleotides of provided compositions comprise six consecutive natural phosphate linkages. In some embodiments, oligonucleotides of provided compositions comprise seven consecutive natural phosphate linkages. In some embodiments, oligonucleotides of provided compositions comprise eight consecutive natural phosphate linkages. In some embodiments, oligonucleotides of provided compositions comprise nine consecutive natural phosphate linkages. In some embodiments, oligonucleotides of provided compositions comprise ten consecutive natural phosphate linkages.

In some embodiments, provided chirally controlled (and/or stereochemically pure) preparations are of oligonucleotides having a common base sequence of at least 8 bases. In some embodiments, provided chirally controlled (and/or stereochemically pure) preparations are of oligonucleotides having a common base sequence of at least 9 bases. In some embodiments, provided chirally controlled (and/or stereochemically pure) preparations are of oligonucleotides having a common base sequence of at least 10 bases. In some embodiments, provided chirally controlled (and/or stereochemically pure) preparations are of oligonucleotides having a common base sequence of at least 11 bases. In some embodiments, provided chirally controlled (and/or stereochemically pure) preparations are of oligonucleotides having a common base sequence of at least 12 bases. In some embodiments, provided chirally controlled (and/or stereochemically pure) preparations are of oligonucleotides having a common base sequence of at least 13 bases. In some embodiments, provided chirally controlled (and/or stereochemically pure) preparations are of oligonucleotides having a common base sequence of at least 14 bases. In some embodiments, provided chirally controlled (and/or stereochemically pure) preparations are of oligonucleotides having a common base sequence of at least 15 bases. In some embodiments, provided chirally controlled (and/or stereochemically pure) preparations are of oligonucleotides having a common base sequence of at least 16 bases. In some embodiments, provided chirally controlled (and/or stereochemically pure) preparations are of oligonucleotides having a common base sequence of at least 17 bases. In some embodiments, provided chirally controlled (and/or stereochemically pure) preparations are of oligonucleotides having a common base sequence of at least 18 bases. In some embodiments, provided chirally controlled (and/or stereochemically pure) preparations are of oligonucleotides having a common base sequence of at least 19 bases. In some embodiments, provided chirally controlled (and/or stereochemically pure) preparations are of oligonucleotides having a common base sequence of at least 20 bases. In some embodiments, provided chirally controlled (and/or stereochemically pure) preparations are of oligonucleotides having a common base sequence of at least 21 bases. In some embodiments, provided chirally controlled (and/or stereochemically pure) preparations are of oligonucleotides having a common base sequence of at least 22 bases. In some embodiments, provided chirally controlled (and/or stereochemically pure) preparations are of oligonucleotides having a common base sequence of at least 23 bases. In some embodiments, provided chirally controlled (and/or stereochemically pure) preparations are of oligonucleotides having a common base sequence of at least 24 bases. In some embodiments, provided chirally controlled (and/or stereochemically pure) preparations are of oligonucleotides having a common base sequence of at least 25 bases. In some embodiments, provided chirally controlled (and/or stereochemically pure) preparations are of oligonucleotides having a common base sequence of at least 30, 35, 40, 45, 50, 55, 60, 65, 70, or 75 bases.

In some embodiments, provided compositions comprise oligonucleotides containing one or more residues which are modified at the sugar moiety. In some embodiments, provided compositions comprise oligonucleotides containing one or more residues which are modified at the 2' position of the sugar moiety (referred to herein as a "2'-modification"). Examples of such modifications are described above and herein and include, but are not limited to, 2'-OMe, 2'-MOE, 2'-LNA, 2'-F, FRNA, FANA, S-cEt, etc. In some embodiments, provided compositions comprise oligonucleotides containing one or more residues which are 2'-modified. For example, in some embodiments, provided oligonucleotides contain one or more residues which are 2'-O-methoxyethyl (2'-MOE)-modified residues. In some embodiments, provided compositions comprise oligonucleotides which do not contain any 2'-modifications. In some embodiments, provided compositions are oligonucleotides which do not contain any 2'-MOE residues. That is, in some embodiments, provided oligonucleotides are not MOE-modified. Additional example sugar modifications are described in the present disclosure.

In some embodiments, provided oligonucleotides are of a general motif of wing-core or core-wing (hemimer, also represented herein generally as X-Y or Y-X, respectively). In some embodiments, provided oligonucleotides are of a general motif of wing-core-wing (gapmer, also represented herein generally as X-Y-X). In some embodiments, each wing region independently contains one or more residues having a particular modification, which modification is absent from the core "Y" portion. In some embodiments, each wing region independently contains one or more residues having a particular nucleoside modification, which modification is absent from the core "Y" portion. In some embodiments, each wing region independently contains one or more residues having a particular base modification, which modification is absent from the core "Y" portion. In some embodiments, each wing region independently contains one or more residues having a particular sugar modification, which modification is absent from the core "Y" portion. Example sugar modifications are widely known in the art. In some embodiments, a sugar modification is a modification selected from those modifications described in U.S. Pat. No. 9,006,198, which sugar modifications are incorporated herein by references. Additional example sugar modifications are described in the present disclosure. In some embodiment, each wing contains one or more residues having a 2' modification that is not present in the core portion. In some embodiments, a 2'-modification is 2'-$OR^1$, wherein $R^1$ is as defined and described in the present disclosure.

In some embodiments, provided oligonucleotides have a wing-core motif represented as X-Y, or a core-wing motif represented as Y-X, wherein the residues at the "X" portion are sugar modified residues of a particular type and the residues in the core "Y" portion are not sugar modified residues of the same particular type. In some embodiments, provided oligonucleotides have a wing-core-wing motif represented as X-Y-X, wherein the residues at each "X" portion are sugar modified residues of a particular type and the residues in the core "Y" portion are not sugar modified residues of the same particular type. In some embodiments, provided oligonucleotides have a wing-core motif represented as X-Y, or a core-wing motif represented as Y-X, wherein the residues at the "X" portion are 2'-modified residues of a particular type and the residues in the core "Y" portion are not 2'-modified residues of the same particular type. In some embodiments, provided oligonucleotides have a wing-core motif represented as X-Y, wherein the residues at the "X" portion are 2'-modified residues of a particular type and the residues in the core "Y" portion are not 2'-modified residues of the same particular type. In some embodiments, provided oligonucleotides have a core-wing motif represented as Y-X, wherein the residues at the "X" portion are 2'-modified residues of a particular type and the residues in the core "Y" portion are not 2'-modified residues of the same particular type. In some embodiments, provided oligonucleotides have a wing-core-wing motif represented as X-Y-X, wherein the residues at each "X" portion are 2'-modified residues of a particular type and the residues in the core "Y" portion are not 2'-modified residues of the same particular type. In some embodiments, provided oligonucleotides have a wing-core motif represented as X-Y, wherein the residues at the "X" portion are 2'-modified residues of a particular type and the residues in the core "Y" portion are 2'-deoxyribonucleoside. In some embodiments, provided oligonucleotides have a core-wing motif represented as Y-X, wherein the residues at the "X" portion are 2'-modified residues of a particular type and the residues in the core "Y" portion are 2'-deoxyribonucleoside. In some embodiments, provided oligonucleotides have a wing-core-wing motif represented as X-Y-X, wherein the residues at each "X" portion are 2'-modified residues of a particular type and the residues in the core "Y" portion are 2'-deoxyribonucleoside. In some embodiments, provided oligonucleotides have a wing-core-wing motif represented as X-Y-X, wherein the residues at each "X" portion are 2'-modified residues of a particular type and the residues in the core "Y" portion are 2'-deoxyribonucleoside. For instance, in some embodiments, provided oligonucleotides have a wing-core-wing motif represented as X-Y-X, wherein the residues at each "X" portion are 2'-MOE-modified residues and the residues in the core "Y" portion are not 2'-MOE-modified residues. In some embodiments, provided oligonucleotides have a wing-core-wing motif represented as X-Y-X, wherein the residues at each "X" portion are 2'-MOE-modified residues and the residues in the core "Y" portion are 2'-deoxyribonucleoside. One of skill in the relevant arts will recognize that all such 2'-modifications described above and herein are contemplated in the context of such X-Y, Y-X and/or X-Y-X motifs.

In some embodiments, a wing has a length of one or more bases. In some embodiments, a wing has a length of two or more bases. In some embodiments, a wing has a length of three or more bases. In some embodiments, a wing has a length of four or more bases. In some embodiments, a wing has a length of five or more bases. In some embodiments, a wing has a length of six or more bases. In some embodiments, a wing has a length of seven or more bases. In some embodiments, a wing has a length of eight or more bases. In some embodiments, a wing has a length of nine or more bases. In some embodiments, a wing has a length of ten or more bases. In some embodiments, a wing has a length of 11 or more bases. In some embodiments, a wing has a length of 12 or more bases. In some embodiments, a wing has a length of 13 or more bases. In some embodiments, a wing has a length of 14 or more bases. In some embodiments, a wing has a length of 15 or more bases. In some embodiments, a wing has a length of 16 or more bases. In some embodiments, a wing has a length of 17 or more bases. In some embodiments, a wing has a length of 18 or more bases. In some embodiments, a wing has a length of 19 or more bases. In some embodiments, a wing has a length of ten or more bases.

In some embodiments, a wing has a length of one base. In some embodiments, a wing has a length of two bases. In some embodiments, a wing has a length of three bases. In some embodiments, a wing has a length of four bases. In some embodiments, a wing has a length of five bases. In some embodiments, a wing has a length of six bases. In some embodiments, a wing has a length of seven bases. In some embodiments, a wing has a length of eight bases. In some embodiments, a wing has a length of nine bases. In some embodiments, a wing has a length of ten bases. In some embodiments, a wing has a length of 11 bases. In some embodiments, a wing has a length of 12 bases. In some embodiments, a wing has a length of 13 bases. In some embodiments, a wing has a length of 14 bases. In some embodiments, a wing has a length of 15 bases. In some embodiments, a wing has a length of 16 bases. In some embodiments, a wing has a length of 17 bases. In some embodiments, a wing has a length of 18 bases. In some embodiments, a wing has a length of 19 bases. In some embodiments, a wing has a length of ten bases.

In some embodiments, a wing comprises one or more chiral internucleotidic linkages. In some embodiments, a wing comprises one or more natural phosphate linkages. In some embodiments, a wing comprises one or more chiral internucleotidic linkages and one or more natural phosphate linkages. In some embodiments, a wing comprises one or more chiral internucleotidic linkages and two or more natural phosphate linkages. In some embodiments, a wing comprises one or more chiral internucleotidic linkages and two or more natural phosphate linkages, wherein two or more natural phosphate linkages are consecutive. In some embodiments, a wing comprises no chiral internucleotidic linkages. In some embodiments, each wing linkage is a natural phosphate linkage. In some embodiments, a wing comprises no phosphate linkages. In some embodiments, each wing is independently a chiral internucleotidic linkage.

In some embodiments, each wing region independently comprises one or more chiral internucleotidic linkages. In some embodiments, each wing region independently comprises one or more natural phosphate linkages. In some embodiments, each wing region independently comprises one or more chiral internucleotidic linkages and one or more natural phosphate linkages. In some embodiments, each wing region independently comprises one or more chiral internucleotidic linkages and two or more natural phosphate linkages. In some embodiments, each wing region independently comprises one or more chiral internucleotidic linkages and two or more natural phosphate linkages, wherein two or more natural phosphate linkages are consecutive.

In some embodiments, each wing region independently comprises at least one chiral internucleotidic linkage. In some embodiments, each wing region independently comprises at least two chiral internucleotidic linkages. In some embodiments, each wing region independently comprises at least three chiral internucleotidic linkages. In some embodiments, each wing region independently comprises at least four chiral internucleotidic linkages. In some embodiments, each wing region independently comprises at least five chiral internucleotidic linkages. In some embodiments, each wing region independently comprises at least six chiral internucleotidic linkages. In some embodiments, each wing region independently comprises at least seven chiral internucleotidic linkages. In some embodiments, each wing region independently comprises at least eight chiral internucleotidic linkages. In some embodiments, each wing region independently comprises at least nine chiral internucleotidic linkages. In some embodiments, each wing region independently comprises at least ten chiral internucleotidic linkages. In some embodiments, each wing region independently comprises at least 11 chiral internucleotidic linkages. In some embodiments, each wing region independently comprises at least 12 chiral internucleotidic linkages. In some embodiments, each wing region independently comprises at least 13 chiral internucleotidic linkages. In some embodiments, each wing region independently comprises at least 14 chiral internucleotidic linkages. In some embodiments, each wing region independently comprises at least 15 chiral internucleotidic linkages. In some embodiments, each wing region independently comprises at least 16 chiral internucleotidic linkages. In some embodiments, each wing region independently comprises at least 17 chiral internucleotidic linkages. In some embodiments, each wing region independently comprises at least 18 chiral internucleotidic linkages. In some embodiments, each wing region independently comprises at least 19 chiral internucleotidic linkages. In some embodiments, each wing region independently comprises at least 20 chiral internucleotidic linkages.

In some embodiments, each wing region independently comprises one chiral internucleotidic linkage. In some embodiments, each wing region independently comprises two chiral internucleotidic linkages. In some embodiments, each wing region independently comprises three chiral internucleotidic linkages. In some embodiments, each wing region independently comprises four chiral internucleotidic linkages. In some embodiments, each wing region independently comprises five chiral internucleotidic linkages. In some embodiments, each wing region independently comprises six chiral internucleotidic linkages. In some embodiments, each wing region independently comprises seven chiral internucleotidic linkages. In some embodiments, each wing region independently comprises eight chiral internucleotidic linkages. In some embodiments, each wing region independently comprises nine chiral internucleotidic linkages. In some embodiments, each wing region independently comprises ten chiral internucleotidic linkages. In some embodiments, each wing region independently comprises 11 chiral internucleotidic linkages. In some embodiments, each wing region independently comprises 12 chiral internucleotidic linkages. In some embodiments, each wing region independently comprises 13 chiral internucleotidic linkages. In some embodiments, each wing region independently comprises 14 chiral internucleotidic linkages. In some embodiments, each wing region independently comprises 15 chiral internucleotidic linkages. In some embodiments, each wing region independently comprises 16 chiral internucleotidic linkages. In some embodiments, each wing region independently comprises 17 chiral internucleotidic linkages. In some embodiments, each wing region independently comprises 18 chiral internucleotidic linkages. In some embodiments, each wing region independently comprises 19 chiral internucleotidic linkages. In some embodiments, each wing region independently comprises 20 chiral internucleotidic linkages.

In some embodiments, each wing region independently comprises at least one consecutive natural phosphate linkage. In some embodiments, each wing region independently comprises at least two consecutive chiral internucleotidic linkages. In some embodiments, each wing region independently comprises at least three consecutive chiral internucleotidic linkages. In some embodiments, each wing region independently comprises at least four consecutive chiral internucleotidic linkages. In some embodiments, each wing region independently comprises at least five consecutive chiral internucleotidic linkages. In some embodiments, each wing region independently comprises at least six consecutive chiral internucleotidic linkages. In some embodiments, each wing region independently comprises at least seven consecutive chiral internucleotidic linkages. In some embodiments, each wing region independently comprises at least eight consecutive chiral internucleotidic linkages. In some embodiments, each wing region independently comprises at least nine consecutive chiral internucleotidic linkages. In some embodiments, each wing region independently comprises at least ten consecutive chiral internucleotidic linkages. In some embodiments, each wing region independently comprises at least 11 consecutive chiral internucleotidic linkages. In some embodiments, each wing region independently comprises at least 12 consecutive chiral internucleotidic linkages. In some embodiments, each wing region independently comprises at least 13 consecutive chiral internucleotidic linkages. In some embodiments, each wing region independently comprises at least 14 consecutive chiral internucleotidic linkages. In some embodiments, each wing region independently comprises at least 15 consecutive chiral internucleotidic linkages. In some embodiments, each wing region independently comprises at least 16 consecutive chiral internucleotidic linkages. In some embodiments, each wing region independently comprises at least 17 consecutive chiral internucleotidic linkages. In some embodiments, each wing region independently comprises at least 18 consecutive chiral internucleotidic linkages. In some embodiments, each wing region independently comprises at least 19 consecutive chiral internucleotidic linkages. In some embodiments, each wing region independently comprises at least 20 consecutive chiral internucleotidic linkages.

In some embodiments, each wing region independently comprises one consecutive natural phosphate linkage. In some embodiments, each wing region independently comprises two consecutive chiral internucleotidic linkages. In some embodiments, each wing region independently comprises three consecutive chiral internucleotidic linkages. In some embodiments, each wing region independently comprises four consecutive chiral internucleotidic linkages. In some embodiments, each wing region independently comprises five consecutive chiral internucleotidic linkages. In some embodiments, each wing region independently comprises six consecutive chiral internucleotidic linkages. In some embodiments, each wing region independently comprises seven consecutive chiral internucleotidic linkages. In some embodiments, each wing region independently comprises eight consecutive chiral internucleotidic linkages. In some embodiments, each wing region independently comprises nine consecutive chiral internucleotidic linkages. In some embodiments, each wing region independently comprises ten consecutive chiral internucleotidic linkages. In some embodiments, each wing region independently comprises 11 consecutive chiral internucleotidic linkages. In some embodiments, each wing region independently comprises 12 consecutive chiral internucleotidic linkages. In some embodiments, each wing region independently comprises 13 consecutive chiral internucleotidic linkages. In some embodiments, each wing region independently comprises 14 consecutive chiral internucleotidic linkages. In some embodiments, each wing region independently comprises 15 consecutive chiral internucleotidic linkages. In some embodiments, each wing region independently comprises 16 consecutive chiral internucleotidic linkages. In some embodiments, each wing region independently comprises 17 consecutive chiral internucleotidic linkages. In some embodiments, each wing region independently comprises 18 consecutive chiral internucleotidic linkages. In some embodiments, each wing region independently comprises 19 consecutive chiral internucleotidic linkages. In some embodiments, each wing region independently comprises 20 consecutive chiral internucleotidic linkages.

In some embodiments, each wing region independently comprises at least one natural phosphate linkage. In some embodiments, each wing region independently comprises at least two natural phosphate linkages. In some embodiments, each wing region independently comprises at least three natural phosphate linkages. In some embodiments, each wing region independently comprises at least four natural phosphate linkages. In some embodiments, each wing region independently comprises at least five natural phosphate linkages. In some embodiments, each wing region independently comprises at least six natural phosphate linkages. In some embodiments, each wing region independently comprises at least seven natural phosphate linkages. In some embodiments, each wing region independently comprises at least eight natural phosphate linkages. In some embodiments, each wing region independently comprises at least nine natural phosphate linkages. In some embodiments, each wing region independently comprises at least ten natural phosphate linkages. In some embodiments, each wing region independently comprises at least 11 natural phosphate linkages. In some embodiments, each wing region independently comprises at least 12 natural phosphate linkages. In some embodiments, each wing region independently comprises at least 13 natural phosphate linkages. In some embodiments, each wing region independently comprises at least 14 natural phosphate linkages. In some embodiments, each wing region independently comprises at least 15 natural phosphate linkages. In some embodiments, each wing region independently comprises at least 16 natural phosphate linkages. In some embodiments, each wing region independently comprises at least 17 natural phosphate linkages. In some embodiments, each wing region independently comprises at least 18 natural phosphate linkages. In some embodiments, each wing region independently comprises at least 19 natural phosphate linkages. In some embodiments, each wing region independently comprises at least 20 natural phosphate linkages.

In some embodiments, each wing region independently comprises one natural phosphate linkage. In some embodiments, each wing region independently comprises two natural phosphate linkages. In some embodiments, each wing region independently comprises three natural phosphate linkages. In some embodiments, each wing region independently comprises four natural phosphate linkages. In some embodiments, each wing region independently comprises five natural phosphate linkages. In some embodiments, each wing region independently comprises six natural phosphate linkages. In some embodiments, each wing region independently comprises seven natural phosphate linkages. In some embodiments, each wing region independently comprises eight natural phosphate linkages. In some embodiments, each wing region independently comprises nine natural phosphate linkages. In some embodiments, each wing region independently comprises ten natural phosphate linkages. In some embodiments, each wing region independently comprises 11 natural phosphate linkages. In some embodiments, each wing region independently comprises 12 natural phosphate linkages. In some embodiments, each wing region independently comprises 13 natural phosphate linkages. In some embodiments, each wing region independently comprises 14 natural phosphate linkages. In some embodiments, each wing region independently comprises 15 natural phosphate linkages. In some embodiments, each wing region independently comprises 16 natural phosphate linkages. In some embodiments, each wing region independently comprises 17 natural phosphate linkages. In some embodiments, each wing region independently comprises 18 natural phosphate linkages. In some embodiments, each wing region independently comprises 19 natural phosphate linkages. In some embodiments, each wing region independently comprises 20 natural phosphate linkages.

In some embodiments, each wing region independently comprises at least one consecutive natural phosphate linkage. In some embodiments, each wing region independently comprises at least two consecutive natural phosphate linkages. In some embodiments, each wing region independently comprises at least three consecutive natural phosphate linkages. In some embodiments, each wing region independently comprises at least four consecutive natural phosphate linkages. In some embodiments, each wing region independently comprises at least five consecutive natural phosphate linkages. In some embodiments, each wing region independently comprises at least six consecutive natural phosphate linkages. In some embodiments, each wing region independently comprises at least seven consecutive natural phosphate linkages. In some embodiments, each wing region independently comprises at least eight consecutive natural phosphate linkages. In some embodiments, each wing region independently comprises at least nine consecutive natural phosphate linkages. In some embodiments, each wing region independently comprises at least ten consecutive natural phosphate linkages. In some embodiments, each wing region independently comprises at least 11 consecutive natural phosphate linkages. In some embodiments, each wing region independently comprises at least 12 consecutive natural phosphate linkages. In some embodiments, each wing region independently comprises at least 13 consecutive natural phosphate linkages. In some embodiments, each wing region independently comprises at least 14 consecutive natural phosphate linkages. In some embodiments, each wing region independently comprises at least 15 consecutive natural phosphate linkages. In some embodiments, each wing region independently comprises at least 16 consecutive natural phosphate linkages. In some embodiments, each wing region independently comprises at least 17 consecutive natural phosphate linkages. In some embodiments, each wing region independently comprises at least 18 consecutive natural phosphate linkages. In some embodiments, each wing region independently comprises at least 19 consecutive natural phosphate linkages. In some embodiments, each wing region independently comprises at least 20 consecutive natural phosphate linkages.

In some embodiments, each wing region independently comprises one consecutive natural phosphate linkage. In some embodiments, each wing region independently comprises two consecutive natural phosphate linkages. In some embodiments, each wing region independently comprises three consecutive natural phosphate linkages. In some embodiments, each wing region independently comprises four consecutive natural phosphate linkages. In some embodiments, each wing region independently comprises five consecutive natural phosphate linkages. In some embodiments, each wing region independently comprises six consecutive natural phosphate linkages. In some embodiments, each wing region independently comprises seven consecutive natural phosphate linkages. In some embodiments, each wing region independently comprises eight consecutive natural phosphate linkages. In some embodiments, each wing region independently comprises nine consecutive natural phosphate linkages. In some embodiments, each wing region independently comprises ten consecutive natural phosphate linkages. In some embodiments, each wing region independently comprises 11 consecutive natural phosphate linkages. In some embodiments, each wing region independently comprises 12 consecutive natural phosphate linkages. In some embodiments, each wing region independently comprises 13 consecutive natural phosphate linkages. In some embodiments, each wing region independently comprises 14 consecutive natural phosphate linkages. In some embodiments, each wing region independently comprises 15 consecutive natural phosphate linkages. In some embodiments, each wing region independently comprises 16 consecutive natural phosphate linkages. In some embodiments, each wing region independently comprises 17 consecutive natural phosphate linkages. In some embodiments, each wing region independently comprises 18 consecutive natural phosphate linkages. In some embodiments, each wing region independently comprises 19 consecutive natural phosphate linkages. In some embodiments, each wing region independently comprises 20 consecutive natural phosphate linkages.

In some embodiments, a wing is to the 5'-end of a core (5'-end wing). In some embodiments, a wing is to the 3'-end of a core (3'-end wing). For example, in WV-1092 (mG*SmGmCmAmC*SA*SA*SG*SG*SG*SC*SA*SC*RA*SG*SmAmCmUmU*SmC (SEQ ID NO: 6)), mG*SmGmCmAmC is a 5'-end wing, *SA*SA*SG*SG*SG*SC*SA*SC*RA*SG*S (SEQ ID NO: 8) is a core, and mAmCmUmU*SmC is a 3'-end wing.

In some embodiments, a 5'-end wing comprises one or more modified internucleotidic linkages and one or more natural phosphate internucleotidic linkages. In some embodiments, a 3'-end wing comprises one or more modified internucleotidic linkages and one or more natural phosphate internucleotidic linkages. In some embodiments, each wing independently comprises one or more modified internucleotidic linkages and one or more natural phosphate internucleotidic linkages. For example, WV-1092 has a 5'-end wing comprises one or more modified internucleotidic linkages and one or more natural phosphate internucleotidic linkages, and a 3'-end wing comprises one or more modified internucleotidic linkages and one or more natural phosphate internucleotidic linkages.

In some embodiments, a 5'-end wing comprises a modified internucleotidic linkage having one or more natural phosphate linkages connecting two or more nucleosides after (to the 3'-end) the modified internucleotidic linkage in the 5'-end wing. For example, a 5'-end wing mG*SmGmCmAmC comprises a modified internucleotidic linkage (mG*SmG) which has three natural phosphate linkages connecting four nucleosides (mGmCmAmC) after the modified internucleotidic linkage in the 5'-end wing. In some embodiments, a 5'-end wing comprises a modified internucleotidic linkages followed by one or more natural phosphate linkages and/or one or more modified internucleotidic linkages, which are followed by one or more natural phosphate linkages in the 5'-end wing (for example, mG*SmG and mG*SmC in mG*SmG*SmCmAmC). In some embodiments, a 5'-end wing comprises a modified internucleotidic linkages followed by one or more natural phosphate linkages in the 5'-end wing. In some embodiments, a 5'-end wing comprises a modified internucleotidic linkages followed by one or more consecutive natural phosphate linkages in the 5'-end wing. In some embodiments, a 5'-end wing comprises a natural phosphate linkage between the two nucleosides at its 3'-end. For example, a 5'-end wing mG*SmGmCmAmC has a natural phosphate linkage between the two nucleosides at its 3'-end (mG*SmGmCmAmC).

In some embodiments, a 3'-end wing comprises a modified internucleotidic linkage having one or more natural phosphate linkages connecting two or more nucleosides before (to the 5'-end) the modified internucleotidic linkage in the 3'-end wing. For example, a 3'-end wing mAmCmUmU*SmC comprises a modified internucleotidic linkage (mU*SmC) which has three natural phosphate linkages connecting four nucleosides (mAmCmUmU) before the modified internucleotidic linkage in the 3'-end wing. In some embodiments, a 3'-end wing comprises a modified internucleotidic linkages preceded by one or more natural phosphate linkages and/or one or more modified internucleotidic linkages, which are preceded by one or more natural phosphate linkages in the 3'-end wing (for example, mU*SmU and mU*SmC in mAmCmU*SmU*SmC). In some embodiments, a 3'-end wing comprises a modified internucleotidic linkages preceded by one or more natural phosphate linkages in the 3'-end wing. In some embodiments, a 3'-end wing comprises a modified internucleotidic linkages preceded by one or more consecutive natural phosphate linkages in the 3'-end wing. In some embodiments, a 3'-end wing comprises a natural phosphate linkage between the two nucleosides at its 5'-end. For example, a 3'-end wing having the structure of mAmCmUmU*SmC has a natural phosphate linkage between the two nucleosides at its 5'-end (mAmCmUmU*SmC).

In some embodiments, one or more is one. In some embodiments, one or more is two. In some embodiments, one or more is three. In some embodiments, one or more is four. In some embodiments, one or more is five. In some embodiments, one or more is six. In some embodiments, one or more is seven. In some embodiments, one or more is eight. In some embodiments, one or more is nine. In some embodiments, one or more is ten. In some embodiments, one or more is at least one. In some embodiments, one or more is at least two. In some embodiments, one or more is at least three. In some embodiments, one or more is at least four. In some embodiments, one or more is at least five. In some embodiments, one or more is at least six. In some embodiments, one or more is at least seven. In some embodiments, one or more is at least eight. In some embodiments, one or more is at least nine. In some embodiments, one or more is at least ten.

In some embodiments, a wing comprises only one chiral internucleotidic linkage. In some embodiments, a 5'-end wing comprises only one chiral internucleotidic linkage. In some embodiments, a 5'-end wing comprises only one chiral internucleotidic linkage at the 5'-end of the wing. In some embodiments, a 5'-end wing comprises only one chiral internucleotidic linkage at the 5'-end of the wing, and the chiral internucleotidic linkage is Rp. In some embodiments, a 5'-end wing comprises only one chiral internucleotidic linkage at the 5'-end of the wing, and the chiral internucleotidic linkage is Sp. In some embodiments, a 3'-end wing comprises only one chiral internucleotidic linkage at the 3'-end of the wing. In some embodiments, a 3'-end wing comprises only one chiral internucleotidic linkage at the 3'-end of the wing, and the chiral internucleotidic linkage is Rp. In some embodiments, a 3'-end wing comprises only one chiral internucleotidic linkage at the 3'-end of the wing, and the chiral internucleotidic linkage is Sp.

In some embodiments, a wing comprises two or more natural phosphate linkages. In some embodiments, all phosphate linkages within a wing are consecutive, and there are no non-phosphate linkages between any two phosphate linkages within a wing.

In some embodiments, a linkage connecting a wing and a core is considered part of the core when describing linkages, e.g., linkage chemistry, linkage stereochemistry, etc. For example, in WV-1092, mG*SmGmCmAmC*SA*SA*SG*SG*SG*SC*SA*SC*RA*SG*SmAmCmUmU*SmC (SEQ ID NO: 6), the underlined linkages may be considered as part of the core (bolded), its 5'-wing (having 2'-OMe on sugar moieties) has one single Sp phosphorothioate linkages at its 5'-end, its 3'-wing (having 2'-OMe on sugar moieties) has one Sp phosphorothioate linkage at its 3'-end, and its core has no 2'-modifications on sugar).

In some embodiments, a 5'-internucleotidic linkage connected to a sugar moiety without a 2'-modification is a modified linkage. In some embodiments, a 5'-internucleotidic linkage connected to a sugar moiety without a 2'-modification is a linkage having the structure of formula I. In some embodiments, a 5'-internucleotidic linkage connected to a sugar moiety without a 2'-modification is phosphorothioate linkage. In some embodiments, a 5'-internucleotidic linkage connected to a sugar moiety without a 2'-modification is a substituted phosphorothioate linkage. In some embodiments, a 5'-internucleotidic linkage connected to a sugar moiety without a 2'-modification is a phosphorothioate triester linkage. In some embodiments, each 5'-internucleotidic linkage connected to a sugar moiety without a 2'-modification is a modified linkage. In some embodiments, each 5'-internucleotidic linkage connected to a sugar moiety without a 2'-modification is a linkage having the structure of formula I. In some embodiments, each 5'-internucleotidic linkage connected to a sugar moiety without a 2'-modification is phosphorothioate linkage. In some embodiments, each 5'-internucleotidic linkage connected to a sugar moiety without a 2'-modification is a substituted phosphorothioate linkage. In some embodiments, each 5'-internucleotidic linkage connected to a sugar moiety without a 2'-modification is a phosphorothioate triester linkage.

In some embodiments, a 3'-internucleotidic linkage connected to a sugar moiety without a 2'-modification is a modified linkage. In some embodiments, a 3'-internucleotidic linkage connected to a sugar moiety without a 2'-modification is a linkage having the structure of formula I. In some embodiments, a 3'-internucleotidic linkage connected to a sugar moiety without a 2'-modification is phosphorothioate linkage. In some embodiments, a 3'-internucleotidic linkage connected to a sugar moiety without a 2'-modification is a substituted phosphorothioate linkage. In some embodiments, a 3'-internucleotidic linkage connected to a sugar moiety without a 2'-modification is a phosphorothioate triester linkage. In some embodiments, each 3'-internucleotidic linkage connected to a sugar moiety without a 2'-modification is a modified linkage. In some embodiments, each 3'-internucleotidic linkage connected to a sugar moiety without a 2'-modification is a linkage having the structure of formula I. In some embodiments, each 3'-internucleotidic linkage connected to a sugar moiety without a 2'-modification is phosphorothioate linkage. In some embodiments, each 3'-internucleotidic linkage connected to a sugar moiety without a 2'-modification is a substituted phosphorothioate linkage. In some embodiments, each 3'-internucleotidic linkage connected to a sugar moiety without a 2'-modification is a phosphorothioate triester linkage.

In some embodiments, both internucleotidic linkages connected to a sugar moiety without a 2'-modification are modified linkages. In some embodiments, both internucleotidic linkages connected to a sugar moiety without a 2'-modification are linkage having the structure of formula I. In some embodiments, both internucleotidic linkages connected to a sugar moiety without a 2'-modification are phosphorothioate linkages. In some embodiments, both internucleotidic linkages connected to a sugar moiety without a 2'-modification are substituted phosphorothioate linkages. In some embodiments, both internucleotidic linkages connected to a sugar moiety without a 2'-modification are phosphorothioate triester linkages. In some embodiments, each internucleotidic linkage connected to a sugar moiety without a 2'-modification is a modified linkage. In some embodiments, each internucleotidic linkage connected to a sugar moiety without a 2'-modification is a linkage having the structure of formula I. In some embodiments, each internucleotidic linkage connected to a sugar moiety without a 2'-modification is phosphorothioate linkage. In some embodiments, each internucleotidic linkage connected to a sugar moiety without a 2'-modification is a substituted phosphorothioate linkage. In some embodiments, each internucleotidic linkage connected to a sugar moiety without a 2'-modification is a phosphorothioate triester linkage.

In some embodiments, a sugar moiety without a 2'-modification is a sugar moiety found in a natural DNA nucleoside.

In some embodiments, for a wing-core-wing structure, the 5'-end wing comprises only one chiral internucleotidic linkage. In some embodiments, for a wing-core-wing structure, the 5'-end wing comprises only one chiral internucleotidic linkage at the 5'-end of the wing. In some embodiments, for a wing-core-wing structure, the 3'-end wing comprises only one chiral internucleotidic linkage. In some embodiments, for a wing-core-wing structure, the 3'-end wing comprises only one chiral internucleotidic linkage at the 3'-end of the wing. In some embodiments, for a wing-core-wing structure, each wing comprises only one chiral internucleotidic linkage. In some embodiments, for a wing-core-wing structure, each wing comprises only one chiral internucleotidic linkage, wherein the 5'-end wing comprises only one chiral internucleotidic linkage at its 5'-end; and the 3'-end wing comprises only one chiral internucleotidic linkage at its 3'-end. In some embodiments, the only chiral internucleotidic linkage in the 5'-wing is Rp. In some embodiments, the only chiral internucleotidic linkage in the 5'-wing is Sp. In some embodiments, the only chiral internucleotidic linkage in the 3'-wing is Rp. In some embodiments, the only chiral internucleotidic linkage in the 3'-wing is Sp. In some embodiments, the only chiral internucleotidic linkage in both the 5'- and the 3'-wings are Sp. In some embodiments, the only chiral internucleotidic linkage in both the 5'- and the 3'-wings are Rp. In some embodiments, the only chiral internucleotidic linkage in the 5'-wing is Sp, and the only chiral internucleotidic linkage in the 3'-wing is Rp. In some embodiments, the only chiral internucleotidic linkage in the 5'-wing is Rp, and the only chiral internucleotidic linkage in the 3'-wing is Sp.

In some embodiments, a wing comprises two chiral internucleotidic linkages. In some embodiments, a wing comprises only two chiral internucleotidic linkages, and one or more natural phosphate linkages. In some embodiments, a wing comprises only two chiral internucleotidic linkages, and two or more natural phosphate linkages. In some embodiments, a wing comprises only two chiral internucleotidic linkages, and two or more consecutive natural phosphate linkages. In some embodiments, a wing comprises only two chiral internucleotidic linkages, and two consecutive natural phosphate linkages. In some embodiments, a wing comprises only two chiral internucleotidic linkages, and three consecutive natural phosphate linkages. In some embodiments, a 5'-wing (to a core) comprises only two chiral internucleotidic linkages, one at its 5'-end and the other at its 3'-end, with one or more natural phosphate linkages in between. In some embodiments, a 5'-wing (to a core) comprises only two chiral internucleotidic linkages, one at its 5'-end and the other at its 3'-end, with two or more natural phosphate linkages in between. In some embodiments, a 3'-wing (to a core) comprises only two chiral internucleotidic linkages, one at its 3'-end and the other at its 3'-end, with one or more natural phosphate linkages in between. In some embodiments, a 3'-wing (to a core) comprises only two chiral internucleotidic linkages, one at its 3'-end and the other at its 3'-end, with two or more natural phosphate linkages in between.

In some embodiments, a 5'-wing comprises only two chiral internucleotidic linkages, one at its 5'-end and the other at its 3'-end, with one or more natural phosphate linkages in between, and the 3'-wing comprise only one internucleotidic linkage at its 3'-end. In some embodiments, a 5'-wing (to a core) comprises only two chiral internucleotidic linkages, one at its 5'-end and the other at its 3'-end, with two or more natural phosphate linkages in between, and the 3'-wing comprise only one internucleotidic linkage at its 3'-end. In some embodiments, each chiral internucleotidic linkage independently has its own stereochemistry. In some embodiments, both chiral internucleotidic linkages in the 5'-wing have the same stereochemistry. In some embodiments, both chiral internucleotidic linkages in the 5'-wing have different stereochemistry. In some embodiments, both chiral internucleotidic linkages in the 5'-wing are Rp. In some embodiments, both chiral internucleotidic linkages in the 5'-wing are Sp. In some embodiments, chiral internucleotidic linkages in the 5'- and 3'-wings have the same stereochemistry. In some embodiments, chiral internucleotidic linkages in the 5'- and 3'-wings are Rp. In some embodiments, chiral internucleotidic linkages in the 5'- and 3'-wings are Sp. In some embodiments, chiral internucleotidic linkages in the 5'- and 3'-wings have different stereochemistry.

In some embodiments, a chiral, modified phosphate linkage is a chiral phosphorothioate linkage, i.e., phosphorothioate internucleotidic linkage. In some embodiments, a wing region comprises at least 5%, 10%, 15%, 20%, 25%, 30%, 35%, 40%, 45%, 50%, 55%, 60%, 65%, 70%, 75%, 80%, 85%, 90%, 95%, or 100% chiral phosphorothioate internucleotidic linkages. In some embodiments, all chiral, modified phosphate linkages are chiral phosphorothioate internucleotidic linkages. In some embodiments, at least about 10%, 20%, 30%, 40%, 50%, 60%, 70%, 80%, or 90% chiral phosphorothioate internucleotidic linkages of a wing region are of the Sp conformation. In some embodiments, at least about 10% chiral phosphorothioate internucleotidic linkages of a wing region are of the Sp conformation. In some embodiments, at least about 20% chiral phosphorothioate internucleotidic linkages of a wing region are of the Sp conformation. In some embodiments, at least about 30% chiral phosphorothioate internucleotidic linkages of a wing region are of the Sp conformation. In some embodiments, at least about 40% chiral phosphorothioate internucleotidic linkages of a wing region are of the Sp conformation. In some embodiments, at least about 50% chiral phosphorothioate internucleotidic linkages of a wing region are of the Sp conformation. In some embodiments, at least about 60% chiral phosphorothioate internucleotidic linkages of a wing region are of the Sp conformation. In some embodiments, at least about 70% chiral phosphorothioate internucleotidic linkages of a wing region are of the Sp conformation. In some embodiments, at least about 80% chiral phosphorothioate internucleotidic linkages of a wing region are of the Sp conformation. In some embodiments, at least about 90% chiral phosphorothioate internucleotidic linkages of a wing region are of the Sp conformation. In some embodiments, at least about 95% chiral phosphorothioate internucleotidic linkages of a wing region are of the Sp conformation.

In some embodiments, at least about 1 chiral phosphorothioate internucleotidic linkage of a wing region is of the Sp conformation. In some embodiments, at least about 2 chiral phosphorothioate internucleotidic linkages of a wing region are of the Sp conformation. In some embodiments, at least about 3 chiral phosphorothioate internucleotidic linkages of a wing region are of the Sp conformation. In some embodiments, at least about 4 chiral phosphorothioate internucleotidic linkages of a wing region are of the Sp conformation. In some embodiments, at least about 5 chiral phosphorothioate internucleotidic linkages of a wing region are of the Sp conformation. In some embodiments, at least about 6 chiral phosphorothioate internucleotidic linkages of a wing region are of the Sp conformation. In some embodiments, at least about 7 chiral phosphorothioate internucleotidic linkages of a wing region are of the Sp conformation. In some embodiments, at least about 8 chiral phosphorothioate internucleotidic linkages of a wing region are of the Sp conformation. In some embodiments, at least about 9 chiral phosphorothioate internucleotidic linkages of a wing region are of the Sp conformation.

In some embodiments, at least about 2 consecutive chiral phosphorothioate internucleotidic linkages of a wing region are of the Sp conformation. In some embodiments, at least about 3 consecutive chiral phosphorothioate internucleotidic linkages of a wing region are of the Sp conformation. In some embodiments, at least about 4 consecutive chiral phosphorothioate internucleotidic linkages of a wing region are of the Sp conformation. In some embodiments, at least about 5 consecutive chiral phosphorothioate internucleotidic linkages of a wing region are of the Sp conformation. In some embodiments, at least about 6 consecutive chiral phosphorothioate internucleotidic linkages of a wing region are of the Sp conformation. In some embodiments, at least about 7 consecutive chiral phosphorothioate internucleotidic linkages of a wing region are of the Sp conformation. In some embodiments, at least about 8 consecutive chiral phosphorothioate internucleotidic linkages of a wing region are of the Sp conformation. In some embodiments, at least about 9 consecutive chiral phosphorothioate internucleotidic linkages of a wing region are of the Sp conformation.

In some embodiments, at least about 10%, 20%, 30%, 40%, 50%, 60%, 70%, 80%, or 90% chiral phosphorothioate internucleotidic linkages of a wing region are of the Rp conformation. In some embodiments, at least about 10% chiral phosphorothioate internucleotidic linkages of a wing region are of the Rp conformation. In some embodiments, at least about 20% chiral phosphorothioate internucleotidic linkages of a wing region are of the Rp conformation. In some embodiments, at least about 30% chiral phosphorothioate internucleotidic linkages of a wing region are of the Rp conformation. In some embodiments, at least about 40% chiral phosphorothioate internucleotidic linkages of a wing region are of the Rp conformation. In some embodiments, at least about 50% chiral phosphorothioate internucleotidic linkages of a wing region are of the Rp conformation. In some embodiments, at least about 60% chiral phosphorothioate internucleotidic linkages of a wing region are of the Rp conformation. In some embodiments, at least about 70% chiral phosphorothioate internucleotidic linkages of a wing region are of the Rp conformation. In some embodiments, at least about 80% chiral phosphorothioate internucleotidic linkages of a wing region are of the Rp conformation. In some embodiments, at least about 90% chiral phosphorothioate internucleotidic linkages of a wing region are of the Rp conformation. In some embodiments, at least about 95% chiral phosphorothioate internucleotidic linkages of a wing region are of the Rp conformation.

In some embodiments, less than about 10%, 20%, 30%, 40%, 50%, 60%, 70%, 80%, or 90% chiral phosphorothioate internucleotidic linkages of a wing region are of the Rp conformation. In some embodiments, less than about 10% chiral phosphorothioate internucleotidic linkages of a wing region are of the Rp conformation. In some embodiments, less than about 20% chiral phosphorothioate internucleotidic linkages of a wing region are of the Rp conformation. In some embodiments, less than about 30% chiral phosphorothioate internucleotidic linkages of a wing region are of the Rp conformation. In some embodiments, less than about 40% chiral phosphorothioate internucleotidic linkages of a wing region are of the Rp conformation. In some embodiments, less than about 50% chiral phosphorothioate internucleotidic linkages of a wing region are of the Rp conformation. In some embodiments, less than about 60% chiral phosphorothioate internucleotidic linkages of a wing region are of the Rp conformation. In some embodiments, less than about 70% chiral phosphorothioate internucleotidic linkages of a wing region are of the Rp conformation. In some embodiments, less than about 80% chiral phosphorothioate internucleotidic linkages of a wing region are of the Rp conformation. In some embodiments, less than about 90% chiral phosphorothioate internucleotidic linkages of a wing region are of the Rp conformation. In some embodiments, less than about 95% chiral phosphorothioate internucleotidic linkages of a wing region are of the Rp conformation. In some embodiments, a wing region has only one Rp chiral phosphorothioate internucleotidic linkages. In some embodiments, a wing region has only one Rp chiral phosphorothioate internucleotidic linkages, wherein all internucleotide linkages are chiral phosphorothioate internucleotidic linkages.

In some embodiments, at least about 1 chiral phosphorothioate internucleotidic linkage of a wing region is of the Rp conformation. In some embodiments, at least about 2 chiral phosphorothioate internucleotidic linkages of a wing region are of the Rp conformation. In some embodiments, at least about 3 chiral phosphorothioate internucleotidic linkages of a wing region are of the Rp conformation. In some embodiments, at least about 4 chiral phosphorothioate internucleotidic linkages of a wing region are of the Rp conformation. In some embodiments, at least about 5 chiral phosphorothioate internucleotidic linkages of a wing region are of the Rp conformation. In some embodiments, at least about 6 chiral phosphorothioate internucleotidic linkages of a wing region are of the Rp conformation. In some embodiments, at least about 7 chiral phosphorothioate internucleotidic linkages of a wing region are of the Rp conformation. In some embodiments, at least about 8 chiral phosphorothioate internucleotidic linkages of a wing region are of the Rp conformation. In some embodiments, at least about 9 chiral phosphorothioate internucleotidic linkages of a wing region are of the Rp conformation.

In some embodiments, at least about 2 consecutive chiral phosphorothioate internucleotidic linkages of a wing region are of the Rp conformation. In some embodiments, at least about 3 consecutive chiral phosphorothioate internucleotidic linkages of a wing region are of the Rp conformation. In some embodiments, at least about 4 consecutive chiral phosphorothioate internucleotidic linkages of a wing region are of the Rp conformation. In some embodiments, at least about 5 consecutive chiral phosphorothioate internucleotidic linkages of a wing region are of the Rp conformation. In some embodiments, at least about 6 consecutive chiral phosphorothioate internucleotidic linkages of a wing region are of the Rp conformation. In some embodiments, at least about 7 consecutive chiral phosphorothioate internucleotidic linkages of a wing region are of the Rp conformation. In some embodiments, at least about 8 consecutive chiral phosphorothioate internucleotidic linkages of a wing region are of the Rp conformation. In some embodiments, at least about 9 consecutive chiral phosphorothioate internucleotidic linkages of a wing region are of the Rp conformation.

In some embodiments, a wing comprises one or more modified sugar moieties. In some embodiments, a wing comprises two or more modified sugar moieties. In some embodiments, a wing comprises three or more modified sugar moieties. In some embodiments, a wing comprises four or more modified sugar moieties. In some embodiments, a wing comprises five or more modified sugar moieties. In some embodiments, a wing comprises six or more modified sugar moieties. In some embodiments, a wing comprises seven or more modified sugar moieties. In some embodiments, a wing comprises eight or more modified sugar moieties. In some embodiments, a wing comprises nine or more modified sugar moieties. In some embodiments, a wing comprises ten or more modified sugar moieties. In some embodiments, a wing comprises 11 or more modified sugar moieties. In some embodiments, a wing comprises 12 or more modified sugar moieties. In some embodiments, a wing comprises 13 or more modified sugar moieties. In some embodiments, a wing comprises 14 or more modified sugar moieties. In some embodiments, a wing comprises 15 or more modified sugar moieties. In some embodiments, a wing comprises 16 or more modified sugar moieties. In some embodiments, a wing comprises 17 or more modified sugar moieties. In some embodiments, a wing comprises 18 or more modified sugar moieties. In some embodiments, a wing comprises 19 or more modified sugar moieties. In some embodiments, a wing comprises 20 or more modified sugar moieties. In some embodiments, a wing comprises 21 or more modified sugar moieties. In some embodiments, a wing comprises 22 or more modified sugar moieties. In some embodiments, a wing comprises 23 or more modified sugar moieties. In some embodiments, a wing comprises 24 or more modified sugar moieties. In some embodiments, a wing comprises 25 or more modified sugar moieties. In some embodiments, a wing comprises 30 or more modified sugar moieties. In some embodiments, a wing comprises 35 or more modified sugar moieties.

In some embodiments, a wing comprises one or more 2'-modified sugar moieties. In some embodiments, a wing comprises two or more 2'-modified sugar moieties. In some embodiments, a wing comprises three or more 2'-modified sugar moieties. In some embodiments, a wing comprises four or more 2'-modified sugar moieties. In some embodiments, a wing comprises five or more 2'-modified sugar moieties. In some embodiments, a wing comprises six or more 2'-modified sugar moieties. In some embodiments, a wing comprises seven or more 2'-modified sugar moieties. In some embodiments, a wing comprises eight or more 2'-modified sugar moieties. In some embodiments, a wing comprises nine or more 2'-modified sugar moieties. In some embodiments, a wing comprises ten or more 2'-modified sugar moieties. In some embodiments, a wing comprises 11 or more 2'-modified sugar moieties. In some embodiments, a wing comprises 12 or more 2'-modified sugar moieties. In some embodiments, a wing comprises 13 or more 2'-modified sugar moieties. In some embodiments, a wing comprises 14 or more 2'-modified sugar moieties. In some embodiments, a wing comprises 15 or more 2'-modified sugar moieties. In some embodiments, a wing comprises 16 or more 2'-modified sugar moieties. In some embodiments, a wing comprises 17 or more 2'-modified sugar moieties. In some embodiments, a wing comprises 18 or more 2'-modified sugar moieties. In some embodiments, a wing comprises 19 or more 2'-modified sugar moieties. In some embodiments, a wing comprises 20 or more 2'-modified sugar moieties. In some embodiments, a wing comprises 21 or more 2'-modified sugar moieties. In some embodiments, a wing comprises 22 or more 2'-modified sugar moieties. In some embodiments, a wing comprises 23 or more 2'-modified sugar moieties. In some embodiments, a wing comprises 24 or more 2'-modified sugar moieties. In some embodiments, a wing comprises 25 or more 2'-modified sugar moieties. In some embodiments, a wing comprises 30 or more 2'-modified sugar moieties. In some embodiments, a wing comprises 35 or more 2'-modified sugar moieties.

In some embodiments, a wing comprises one or more 2'-F. In some embodiments, a wing comprises two or more 2'-F. In some embodiments, a wing comprises three or more 2'-F. In some embodiments, a wing comprises four or more 2'-F. In some embodiments, a wing comprises five or more 2'-F. In some embodiments, a wing comprises six or more 2'-F. In some embodiments, a wing comprises seven or more 2'-F. In some embodiments, a wing comprises eight or more 2'-F. In some embodiments, a wing comprises nine or more 2'-F. In some embodiments, a wing comprises ten or more 2'-F. In some embodiments, a wing comprises 11 or more 2'-F. In some embodiments, a wing comprises 12 or more 2'-F. In some embodiments, a wing comprises 13 or more 2'-F. In some embodiments, a wing comprises 14 or more 2'-F. In some embodiments, a wing comprises 15 or more 2'-F. In some embodiments, a wing comprises 16 or more 2'-F. In some embodiments, a wing comprises 17 or more 2'-F. In some embodiments, a wing comprises 18 or more 2'-F. In some embodiments, a wing comprises 19 or more 2'-F. In some embodiments, a wing comprises 20 or more 2'-F. In some embodiments, a wing comprises 21 or more 2'-F. In some embodiments, a wing comprises 22 or more 2'-F. In some embodiments, a wing comprises 23 or more 2'-F. In some embodiments, a wing comprises 24 or more 2'-F. In some embodiments, a wing comprises 25 or more 2'-F. In some embodiments, a wing comprises 30 or more 2'-F. In some embodiments, a wing comprises 35 or more 2'-F.

In some embodiments, a wing comprises one 2'-F. In some embodiments, a wing comprises two 2'-F. In some embodiments, a wing comprises three 2'-F. In some embodiments, a wing comprises four 2'-F. In some embodiments, a wing comprises five 2'-F. In some embodiments, a wing comprises six 2'-F. In some embodiments, a wing comprises seven 2'-F. In some embodiments, a wing comprises eight 2'-F. In some embodiments, a wing comprises nine 2'-F. In some embodiments, a wing comprises ten 2'-F. In some embodiments, a wing comprises 11 2'-F. In some embodiments, a wing comprises 12 2'-F. In some embodiments, a wing comprises 13 2'-F. In some embodiments, a wing comprises 14 2'-F. In some embodiments, a wing comprises 15 2'-F. In some embodiments, a wing comprises 16 2'-F. In some embodiments, a wing comprises 17 2'-F. In some embodiments, a wing comprises 18 2'-F. In some embodiments, a wing comprises 19 2'-F. In some embodiments, a wing comprises 20 2'-F. In some embodiments, a wing comprises 21 2'-F. In some embodiments, a wing comprises 22 2'-F. In some embodiments, a wing comprises 23 2'-F. In some embodiments, a wing comprises 24 2'-F. In some embodiments, a wing comprises 25 2'-F. In some embodiments, a wing comprises 30 2'-F. In some embodiments, a wing comprises 35 2'-F.

In some embodiments, a wing comprises one or more consecutive 2'-F. In some embodiments, a wing comprises two or more consecutive 2'-F. In some embodiments, a wing comprises three or more consecutive 2'-F. In some embodiments, a wing comprises four or more consecutive 2'-F. In some embodiments, a wing comprises five or more consecutive 2'-F. In some embodiments, a wing comprises six or more consecutive 2'-F. In some embodiments, a wing comprises seven or more consecutive 2'-F. In some embodiments, a wing comprises eight or more consecutive 2'-F. In some embodiments, a wing comprises nine or more consecutive 2'-F. In some embodiments, a wing comprises ten or more consecutive 2'-F. In some embodiments, a wing comprises 11 or more consecutive 2'-F. In some embodiments, a wing comprises 12 or more consecutive 2'-F. In some embodiments, a wing comprises 13 or more consecutive 2'-F. In some embodiments, a wing comprises 14 or more consecutive 2'-F. In some embodiments, a wing comprises 15 or more consecutive 2'-F. In some embodiments, a wing comprises 16 or more consecutive 2'-F. In some embodiments, a wing comprises 17 or more consecutive 2'-F. In some embodiments, a wing comprises 18 or more consecutive 2'-F. In some embodiments, a wing comprises 19 or more consecutive 2'-F. In some embodiments, a wing comprises 20 or more consecutive 2'-F. In some embodiments, a wing comprises 21 or more consecutive 2'-F. In some embodiments, a wing comprises 22 or more consecutive 2'-F. In some embodiments, a wing comprises 23 or more consecutive 2'-F. In some embodiments, a wing comprises 24 or more consecutive 2'-F. In some embodiments, a wing comprises 25 or more consecutive 2'-F. In some embodiments, a wing comprises 30 or more consecutive 2'-F. In some embodiments, a wing comprises 35 or more consecutive 2'-F.

In some embodiments, a wing comprises one consecutive 2'-F. In some embodiments, a wing comprises two consecutive 2'-F. In some embodiments, a wing comprises three consecutive 2'-F. In some embodiments, a wing comprises four consecutive 2'-F. In some embodiments, a wing comprises five consecutive 2'-F. In some embodiments, a wing comprises six consecutive 2'-F. In some embodiments, a wing comprises seven consecutive 2'-F. In some embodiments, a wing comprises eight consecutive 2'-F. In some embodiments, a wing comprises nine consecutive 2'-F. In some embodiments, a wing comprises ten consecutive 2'-F. In some embodiments, a wing comprises 11 consecutive 2'-F. In some embodiments, a wing comprises 12 consecutive 2'-F. In some embodiments, a wing comprises 13 consecutive 2'-F. In some embodiments, a wing comprises 14 consecutive 2'-F. In some embodiments, a wing comprises 15 consecutive 2'-F. In some embodiments, a wing comprises 16 consecutive 2'-F. In some embodiments, a wing comprises 17 consecutive 2'-F. In some embodiments, a wing comprises 18 consecutive 2'-F. In some embodiments, a wing comprises 19 consecutive 2'-F. In some embodiments, a wing comprises 20 consecutive 2'-F. In some embodiments, a wing comprises 21 consecutive 2'-F. In some embodiments, a wing comprises 22 consecutive 2'-F. In some embodiments, a wing comprises 23 consecutive 2'-F. In some embodiments, a wing comprises 24 consecutive 2'-F. In some embodiments, a wing comprises 25 consecutive 2'-F. In some embodiments, a wing comprises 30 consecutive 2'-F. In some embodiments, a wing comprises 35 consecutive 2'-F.

In some embodiments, in vitro studies performed with provided oligonucleotides were performed with gymnotic introduction of the nucleic acids into cells (without transfection reagent). In some embodiments, experimental data has shown that effects of 2'-modifications are not independent of the manner of introduction of oligonucleotides into cells. In some embodiments, for example, some oligonucleotides which were fully 2'-F modified had higher efficacy when transfected (with transfection reagent), particularly at low concentrations.

In some embodiments, a core region has a length of one or more bases. In some embodiments, a core region has a length of two or more bases. In some embodiments, a core region has a length of three or more bases. In some embodiments, a core region has a length of four or more bases. In some embodiments, a core region has a length of five or more bases. In some embodiments, a core region has a length of six or more bases. In some embodiments, a core region has a length of seven or more bases. In some embodiments, a core region has a length of eight or more bases. In some embodiments, a core region has a length of nine or more bases. In some embodiments, a core region has a length of ten or more bases. In some embodiments, a core region has a length of 11, 12, 13, 14, 15, 16, 17, 18, 19, 20, 25, or more bases. In certain embodiments, a core region has a length of 11 or more bases. In certain embodiments, a core region has a length of 12 or more bases. In certain embodiments, a core region has a length of 13 or more bases. In certain embodiments, a core region has a length of 14 or more bases. In certain embodiments, a core region has a length of 15 or more bases. In certain embodiments, a core region has a length of 16 or more bases. In certain embodiments, a core region has a length of 17 or more bases. In certain embodiments, a core region has a length of 18 or more bases. In certain embodiments, a core region has a length of 19 or more bases. In certain embodiments, a core region has a length of 20 or more bases. In certain embodiments, a core region has a length of more than 20 bases. In certain embodiments, a core region has a length of 2 bases. In certain embodiments, a core region has a length of 3 bases. In certain embodiments, a core region has a length of 4 bases. In certain embodiments, a core region has a length of 5 bases. In certain embodiments, a core region has a length of 6 bases. In certain embodiments, a core region has a length of 7 bases. In certain embodiments, a core region has a length of 8 bases. In certain embodiments, a core region has a length of 9 bases. In certain embodiments, a core region has a length of 10 bases. In certain embodiments, a core region has a length of 11 bases. In certain embodiments, a core region has a length of 12 bases. In certain embodiments, a core region has a length of 13 bases. In certain embodiments, a core region has a length of 14 bases. In certain embodiments, a core region has a length of 15 bases. In certain embodiments, a core region has a length of 16 bases. In certain embodiments, a core region has a length of 17 bases. In certain embodiments, a core region has a length of 18 bases. In certain embodiments, a core region has a length of 19 bases. In certain embodiments, a core region has a length of 20 bases.

In some embodiments, a core comprises one or more modified internucleotidic linkages. In some embodiments, a core comprises one or more natural phosphate linkages. In some embodiments, a core independently comprises one or more modified internucleotidic linkages and one or more natural phosphate linkages. In some embodiments, a core comprises no natural phosphate linkages. In some embodiments, each core linkage is a modified internucleotidic linkage.

In some embodiments, a core comprises at least one natural phosphate linkage. In some embodiments, a core comprises at least two natural phosphate linkages. In some embodiments, a core comprises at least three natural phosphate linkages. In some embodiments, a core comprises at least four natural phosphate linkages. In some embodiments, a core comprises at least five natural phosphate linkages. In some embodiments, a core comprises at least six natural phosphate linkages. In some embodiments, a core comprises at least seven natural phosphate linkages. In some embodiments, a core comprises at least eight natural phosphate linkages. In some embodiments, a core comprises at least nine natural phosphate linkages. In some embodiments, a core comprises at least ten natural phosphate linkages. In some embodiments, a core comprises at least two modified internucleotidic linkages. In some embodiments, a core comprises at least three modified internucleotidic linkages. In some embodiments, a core comprises at least four modified internucleotidic linkages. In some embodiments, a core comprises at least five modified internucleotidic linkages. In some embodiments, a core comprises at least six modified internucleotidic linkages. In some embodiments, a core comprises at least seven modified internucleotidic linkages. In some embodiments, a core comprises at least eight modified internucleotidic linkages. In some embodiments, a core comprises at least nine modified internucleotidic linkages. In some embodiments, a core comprises at least ten modified internucleotidic linkages. In some embodiments, a core comprises at least 11 modified internucleotidic linkages. In some embodiments, a core comprises at least 12 modified internucleotidic linkages. In some embodiments, a core comprises at least 13 modified internucleotidic linkages. In some embodiments, a core comprises at least 14 modified internucleotidic linkages. In some embodiments, a core comprises at least 15 modified internucleotidic linkages. In some embodiments, a core comprises at least 16 modified internucleotidic linkages. In some embodiments, a core comprises at least 17 modified internucleotidic linkages. In some embodiments, a core comprises at least 18 modified internucleotidic linkages. In some embodiments, a core comprises at least 19 modified internucleotidic linkages. In some embodiments, a core comprises at least 20 modified internucleotidic linkages.

In some embodiments, a core comprises one or more chiral internucleotidic linkages. In some embodiments, a core comprises one or more natural phosphate linkages. In some embodiments, a core independently comprises one or more chiral internucleotidic linkages and one or more natural phosphate linkages. In some embodiments, a core comprises no natural phosphate linkages. In some embodiments, each core linkage is a chiral internucleotidic linkage.

In some embodiments, a core comprises at least one natural phosphate linkage. In some embodiments, a core comprises at least two chiral internucleotidic linkages. In some embodiments, a core comprises at least three chiral internucleotidic linkages. In some embodiments, a core comprises at least four chiral internucleotidic linkages. In some embodiments, a core comprises at least five chiral internucleotidic linkages. In some embodiments, a core comprises at least six chiral internucleotidic linkages. In some embodiments, a core comprises at least seven chiral internucleotidic linkages. In some embodiments, a core comprises at least eight chiral internucleotidic linkages. In some embodiments, a core comprises at least nine chiral internucleotidic linkages. In some embodiments, a core comprises at least ten chiral internucleotidic linkages. In some embodiments, a core comprises at least 11 chiral internucleotidic linkages. In some embodiments, a core comprises at least 12 chiral internucleotidic linkages. In some embodiments, a core comprises at least 13 chiral internucleotidic linkages. In some embodiments, a core comprises at least 14 chiral internucleotidic linkages. In some embodiments, a core comprises at least 15 chiral internucleotidic linkages. In some embodiments, a core comprises at least 16 chiral internucleotidic linkages. In some embodiments, a core comprises at least 17 chiral internucleotidic linkages. In some embodiments, a core comprises at least 18 chiral internucleotidic linkages. In some embodiments, a core comprises at least 19 chiral internucleotidic linkages. In some embodiments, a core comprises at least 20 chiral internucleotidic linkages.

In some embodiments, a core comprises one natural phosphate linkage. In some embodiments, a core comprises two chiral internucleotidic linkages. In some embodiments, a core comprises three chiral internucleotidic linkages. In some embodiments, a core comprises four chiral internucleotidic linkages. In some embodiments, a core comprises five chiral internucleotidic linkages. In some embodiments, a core comprises six chiral internucleotidic linkages. In some embodiments, a core comprises seven chiral internucleotidic linkages. In some embodiments, a core comprises eight chiral internucleotidic linkages. In some embodiments, a core comprises nine chiral internucleotidic linkages. In some embodiments, a core comprises ten chiral internucleotidic linkages. In some embodiments, a core comprises 11 chiral internucleotidic linkages. In some embodiments, a core comprises 12 chiral internucleotidic linkages. In some embodiments, a core comprises 13 chiral internucleotidic linkages. In some embodiments, a core comprises 14 chiral internucleotidic linkages. In some embodiments, a core comprises 15 chiral internucleotidic linkages. In some embodiments, a core comprises 16 chiral internucleotidic linkages. In some embodiments, a core comprises 17 chiral internucleotidic linkages. In some embodiments, a core comprises 18 chiral internucleotidic linkages. In some embodiments, a core comprises 19 chiral internucleotidic linkages. In some embodiments, a core comprises 20 chiral internucleotidic linkages.

In some embodiments, a core region has a pattern of backbone chiral centers comprising (Sp)m(Rp)n, (Rp)n(Sp)m, (Np)t(Rp)n(Sp)m, or (Sp)t(Rp)n(Sp)m, wherein each of m, n, t and Np is independently as defined and described in the present disclosure. In some embodiments, a core region has a pattern of backbone chiral centers comprising (Sp)m(Rp)n, (Rp)n(Sp)m, (Np)t(Rp)n(Sp)m, or (Sp)t(Rp)n(Sp)m. In some embodiments, a core region has a pattern of backbone chiral centers comprising (Sp)m(Rp)n. In some embodiments, a core region has a pattern of backbone chiral centers comprising (Sp)m(Rp)n, wherein m>2 and n is 1. In some embodiments, a core region has a pattern of backbone chiral centers comprising (Rp)n(Sp)m. In some embodiments, a core region has a pattern of backbone chiral centers comprising (Rp)n(Sp)m, wherein m>2 and n is 1. In some embodiments, a core region has a pattern of backbone chiral centers comprising (Np)t(Rp)n(Sp)m. In some embodiments, a core region has a pattern of backbone chiral centers comprising (Np)t(Rp)n(Sp)m, wherein m>2 and n is 1. In some embodiments, a core region has a pattern of backbone chiral centers comprising (Np)t(Rp)n(Sp)m, wherein t>2, m>2 and n is 1. In some embodiments, a core region has a pattern of backbone chiral centers comprising (Sp)t(Rp)n(Sp)m. In some embodiments, a core region has a pattern of backbone chiral centers comprising (Sp)t(Rp)n(Sp)m, wherein m>2 and n is 1. In some embodiments, a core region has a pattern of backbone chiral centers comprising (Sp)t(Rp)n(Sp)m, wherein t>2, m>2 and n is 1. Among other things, the present disclosure demonstrates that, in some embodiments, such patterns can provide and/or enhance controlled cleavage, improved cleavage rate, selectivity, etc., of a target sequence, e.g., an RNA sequence. Example patterns of backbone chiral centers are described in the present disclosure.

In some embodiments, at least 60% of the chiral internucleotidic linkages in the core region are Sp. In some embodiments, at least 65% of the chiral internucleotidic linkages in the core region are Sp. In some embodiments, at least 66% of the chiral internucleotidic linkages in the core region are Sp. In some embodiments, at least 67% of the chiral internucleotidic linkages in the core region are Sp. In some embodiments, at least 70% of the chiral internucleotidic linkages in the core region are Sp. In some embodiments, at least 75% of the chiral internucleotidic linkages in the core region are Sp. In some embodiments, at least 80% of the chiral internucleotidic linkages in the core region are Sp. In some embodiments, at least 85% of the chiral internucleotidic linkages in the core region are Sp. In some embodiments, at least 90% of the chiral internucleotidic linkages in the core region are Sp. In some embodiments, at least 95% of the chiral internucleotidic linkages in the core region are Sp.

In some embodiments, each chiral internucleotidic linkages in the core region is Sp.

In some embodiments, at least 1 core region internucleotidic linkage is Sp. In some embodiments, at least 2 core region internucleotidic linkages are Sp. In some embodiments, at least 3 core region internucleotidic linkages are Sp. In some embodiments, at least 4 core region internucleotidic linkages are Sp. In some embodiments, at least 5 core region internucleotidic linkages are Sp. In some embodiments, at least 6 core region internucleotidic linkages are Sp. In some embodiments, at least 7 core region internucleotidic linkages are Sp. In some embodiments, at least 8 core region internucleotidic linkages are Sp. In some embodiments, at least 9 core region internucleotidic linkages are Sp. In some embodiments, at least 10 core region internucleotidic linkages are Sp. In some embodiments, at least 11 core region internucleotidic linkages are Sp. In some embodiments, at least 12 core region internucleotidic linkages are Sp. In some embodiments, at least 13 core region internucleotidic linkages are Sp. In some embodiments, at least 14 core region internucleotidic linkages are Sp. In some embodiments, at least 15 core region internucleotidic linkages are Sp. In some embodiments, at least 16 core region internucleotidic linkages are Sp. In some embodiments, at least 17 core region internucleotidic linkages are Sp. In some embodiments, at least 18 core region internucleotidic linkages are Sp. In some embodiments, at least 19 core region internucleotidic linkages are Sp. In some embodiments, at least 20 core region internucleotidic linkages are Sp. In some embodiments, at least 21 core region internucleotidic linkages are Sp. In some embodiments, at least two core region internucleotidic linkages are Sp. In some embodiments, the Sp internucleotidic linkages are consecutive.

In some embodiments, at least 60% of the chiral internucleotidic linkages in the core region are Rp. In some embodiments, at least 65% of the chiral internucleotidic linkages in the core region are Rp. In some embodiments, at least 66% of the chiral internucleotidic linkages in the core region are Rp. In some embodiments, at least 67% of the chiral internucleotidic linkages in the core region are Rp. In some embodiments, at least 70% of the chiral internucleotidic linkages in the core region are Rp. In some embodiments, at least 75% of the chiral internucleotidic linkages in the core region are Rp. In some embodiments, at least 80% of the chiral internucleotidic linkages in the core region are Rp. In some embodiments, at least 85% of the chiral internucleotidic linkages in the core region are Rp. In some emIn some embodiments, each chiral internucleotidic linkages in the core region is Rp.

In some embodiments, at least 1 core region internucleotidic linkage is Rp. In some embodiments, at least 2 core region internucleotidic linkages are Rp. In some embodiments, at least 3 core region internucleotidic linkages are Rp. In some embodiments, at least 4 core region internucleotidic linkages are Rp. In some embodiments, at least 5 core region internucleotidic linkages are Rp. In some embodiments, at least 6 core region internucleotidic linkages are Rp. In some embodiments, at least 7 core region internucleotidic linkages are Rp. In some embodiments, at least 8 core region internucleotidic linkages are Rp. In some embodiments, at least 9 core region internucleotidic linkages are Rp. In some embodiments, at least 10 core region internucleotidic linkages are Rp. In some embodiments, at least 11 core region internucleotidic linkages are Rp. In some embodiments, at least 12 core region internucleotidic linkages are Rp. In some embodiments, at least 13 core region internucleotidic linkages are Rp. In some embodiments, at least 14 core region internucleotidic linkages are Rp. In some embodiments, at least 15 core region internucleotidic linkages are Rp. In some embodiments, at least 16 core region internucleotidic linkages are Rp. In some embodiments, at least 17 core region internucleotidic linkages are Rp. In some embodiments, at least 18 core region internucleotidic linkages are Rp. In some embodiments, at least 19 core region internucleotidic linkages are Rp. In some embodiments, at least 20 core region internucleotidic linkages are Rp. In some embodiments, at least 21 core region internucleotidic linkages are Rp. In some embodiments, at least two core region internucleotidic linkages are Rp. In some embodiments, the Rp internucleotidic linkages are consecutive.

In some embodiments, a core comprises one or more modified sugar moieties. In some embodiments, a core comprises two or more modified sugar moieties. In some embodiments, a core comprises three or more modified sugar moieties. In some embodiments, a core comprises four or more modified sugar moieties. In some embodiments, a core comprises five or more modified sugar moieties. In some embodiments, a core comprises six or more modified sugar moieties. In some embodiments, a core comprises seven or more modified sugar moieties. In some embodiments, a core comprises eight or more modified sugar moieties. In some embodiments, a core comprises nine or more modified sugar moieties. In some embodiments, a core comprises ten or more modified sugar moieties. In some embodiments, a core comprises 11 or more modified sugar moieties. In some embodiments, a core comprises 12 or more modified sugar moieties. In some embodiments, a core comprises 13 or more modified sugar moieties. In some embodiments, a core comprises 14 or more modified sugar moieties. In some embodiments, a core comprises 15 or more modified sugar moieties. In some embodiments, a core comprises 16 or more modified sugar moieties. In some embodiments, a core comprises 17 or more modified sugar moieties. In some embodiments, a core comprises 18 or more modified sugar moieties. In some embodiments, a core comprises 19 or more modified sugar moieties. In some embodiments, a core comprises 20 or more modified sugar moieties. In some embodiments, a core comprises 21 or more modified sugar moieties. In some embodiments, a core comprises 22 or more modified sugar moieties. In some embodiments, a core comprises 23 or more modified sugar moieties. In some embodiments, a core comprises 24 or more modified sugar moieties. In some embodiments, a core comprises 25 or more modified sugar moieties. In some embodiments, a core comprises 30 or more modified sugar moieties. In some embodiments, a core comprises 35 or more modified sugar moieties. In some embodiments, a 2'-modification is 2'-$OR^1$. In some embodiments, a 2'-modification is 2'-OMe.

In some embodiments, a core comprises one or more 2'-modified sugar moieties. In some embodiments, a core comprises two or more 2'-modified sugar moieties. In some embodiments, a core comprises three or more 2'-modified sugar moieties. In some embodiments, a core comprises four or more 2'-modified sugar moieties. In some embodiments, a core comprises five or more 2'-modified sugar moieties. In some embodiments, a core comprises six or more 2'-modified sugar moieties. In some embodiments, a core comprises seven or more 2'-modified sugar moieties. In some embodiments, a core comprises eight or more 2'-modified sugar moieties. In some embodiments, a core comprises nine or more 2'-modified sugar moieties. In some embodiments, a core comprises ten or more 2'-modified sugar moieties. In some embodiments, a core comprises 11 or more 2'-modified sugar moieties. In some embodiments, a core comprises 12 or more 2'-modified sugar moieties. In some embodiments, a core comprises 13 or more 2'-modified sugar moieties. In some embodiments, a core comprises 14 or more 2'-modified sugar moieties. In some embodiments, a core comprises 15 or more 2'-modified sugar moieties. In some embodiments, a core comprises 16 or more 2'-modified sugar moieties. In some embodiments, a core comprises 17 or more 2'-modified sugar moieties. In some embodiments, a core comprises 18 or more 2'-modified sugar moieties. In some embodiments, a core comprises 19 or more 2'-modified sugar moieties. In some embodiments, a core comprises 20 or more 2'-modified sugar moieties. In some embodiments, a core comprises 21 or more 2'-modified sugar moieties. In some embodiments, a core comprises 22 or more 2'-modified sugar moieties. In some embodiments, a core comprises 23 or more 2'-modified sugar moieties. In some embodiments, a core comprises 24 or more 2'-modified sugar moieties. In some embodiments, a core comprises 25 or more 2'-modified sugar moieties. In some embodiments, a core comprises 30 or more 2'-modified sugar moieties. In some embodiments, a core comprises 35 or more 2'-modified sugar moieties. In some embodiments, a 2'-modification is 2'-$OR^1$. In some embodiments, a 2'-modification is 2'-OMe.

In some embodiments, at least about 1 chiral phosphorothioate internucleotidic linkage of a wing region is of the Rp conformation. In some embodiments, at least about 2 chiral phosphorothioate internucleotidic linkages of a wing region are of the Rp conformation. In some embodiments, at least about 3 chiral phosphorothioate internucleotidic linkages of a wing region are of the Rp conformation. In some embodiments, at least about 4 chiral phosphorothioate internucleotidic linkages of a wing region are of the Rp conformation. In some embodiments, at least about 5 chiral phosphorothioate internucleotidic linkages of a wing region are of the Rp conformation. In some embodiments, at least about 6 chiral phosphorothioate internucleotidic linkages of a wing region are of the Rp conformation. In some embodiments, at least about 7 chiral phosphorothioate internucleotidic linkages of a wing region are of the Rp conformation. In some embodiments, at least about 8 chiral phosphorothioate internucleotidic linkages of a wing region are of the Rp conformation.

In some embodiments, at least about 9 chiral phosphorothioate internucleotidic linkages of a wing region are of the Rp conformation.

In some embodiments, at least about 2 consecutive chiral phosphorothioate internucleotidic linkages of a wing region are of the Rp conformation. In some embodiments, at least about 3 consecutive chiral phosphorothioate internucleotidic linkages of a wing region are of the Rp conformation. In some embodiments, at least about 4 consecutive chiral phosphorothioate internucleotidic linkages of a wing region are of the Rp conformation. In some embodiments, at least about 5 consecutive chiral phosphorothioate internucleotidic linkages of a wing region are of the Rp conformation. In some embodiments, at least about 6 consecutive chiral phosphorothioate internucleotidic linkages of a wing region are of the Rp conformation. In some embodiments, at least about 7 consecutive chiral phosphorothioate internucleotidic linkages of a wing region are of the Rp conformation. In some embodiments, at least about 8 consecutive chiral phosphorothioate internucleotidic linkages of a wing region are of the Rp conformation. In some embodiments, at least about 9 consecutive chiral phosphorothioate internucleotidic linkages of a wing region are of the Rp conformation.

In some embodiments, a wing comprises one or more modified sugar moieties. In some embodiments, a wing comprises two or more modified sugar moieties. In some embodiments, a wing comprises three or more modified sugar moieties. In some embodiments, a wing comprises four or more modified sugar moieties. In some embodiments, a wing comprises five or more modified sugar moieties. In some embodiments, a wing comprises six or more modified sugar moieties. In some embodiments, a wing comprises seven or more modified sugar moieties. In some embodiments, a wing comprises eight or more modified sugar moieties. In some embodiments, a wing comprises nine or more modified sugar moieties. In some embodiments, a wing comprises ten or more modified sugar moieties. In some embodiments, a wing comprises 11 or more modified sugar moieties. In some embodiments, a wing comprises 12 or more modified sugar moieties. In some embodiments, a wing comprises 13 or more modified sugar moieties. In some embodiments, a wing comprises 14 or more modified sugar moieties. In some embodiments, a wing comprises 15 or more modified sugar moieties. In some embodiments, a wing comprises 16 or more modified sugar moieties. In some embodiments, a wing comprises 17 or more modified sugar moieties. In some embodiments, a wing comprises 18 or more modified sugar moieties. In some embodiments, a wing comprises 19 or more modified sugar moieties. In some embodiments, a wing comprises 20 or more modified sugar moieties. In some embodiments, a wing comprises 21 or more modified sugar moieties. In some embodiments, a wing comprises 22 or more modified sugar moieties. In some embodiments, a wing comprises 23 or more modified sugar moieties. In some embodiments, a wing comprises 24 or more modified sugar moieties. In some embodiments, a wing comprises 25 or more modified sugar moieties. In some embodiments, a wing comprises 30 or more modified sugar moieties. In some embodiments, a wing comprises 35 or more modified sugar moieties.

In some embodiments, a wing comprises one or more 2'-modified sugar moieties. In some embodiments, a wing comprises two or more 2'-modified sugar moieties. In some embodiments, a wing comprises three or more 2'-modified sugar moieties. In some embodiments, a wing comprises four or more 2'-modified sugar moieties. In some embodiments, a wing comprises five or more 2'-modified sugar moieties. In some embodiments, a wing comprises six or more 2'-modified sugar moieties. In some embodiments, a wing comprises seven or more 2'-modified sugar moieties. In some embodiments, a wing comprises eight or more 2'-modified sugar moieties. In some embodiments, a wing comprises nine or more 2'-modified sugar moieties. In some embodiments, a wing comprises ten or more 2'-modified sugar moieties. In some embodiments, a wing comprises 11 or more 2'-modified sugar moieties. In some embodiments, a wing comprises 12 or more 2'-modified sugar moieties. In some embodiments, a wing comprises 13 or more 2'-modified sugar moieties. In some embodiments, a wing comprises 14 or more 2'-modified sugar moieties. In some embodiments, a wing comprises 15 or more 2'-modified sugar moieties. In some embodiments, a wing comprises 16 or more 2'-modified sugar moieties. In some embodiments, a wing comprises 17 or more 2'-modified sugar moieties. In some embodiments, a wing comprises 18 or more 2'-modified sugar moieties. In some embodiments, a wing comprises 19 or more 2'-modified sugar moieties. In some embodiments, a wing comprises 20 or more 2'-modified sugar moieties. In some embodiments, a wing comprises 21 or more 2'-modified sugar moieties. In some embodiments, a wing comprises 22 or more 2'-modified sugar moieties. In some embodiments, a wing comprises 23 or more 2'-modified sugar moieties. In some embodiments, a wing comprises 24 or more 2'-modified sugar moieties. In some embodiments, a wing comprises 25 or more 2'-modified sugar moieties. In some embodiments, a wing comprises 30 or more 2'-modified sugar moieties. In some embodiments, a wing comprises 35 or more 2'-modified sugar moieties.

In some embodiments, a wing comprises one or more 2'-F. In some embodiments, a wing comprises two or more 2'-F. In some embodiments, a wing comprises three or more 2'-F. In some embodiments, a wing comprises four or more 2'-F. In some embodiments, a wing comprises five or more 2'-F. In some embodiments, a wing comprises six or more 2'-F. In some embodiments, a wing comprises seven or more 2'-F. In some embodiments, a wing comprises eight or more 2'-F. In some embodiments, a wing comprises nine or more 2'-F. In some embodiments, a wing comprises ten or more 2'-F. In some embodiments, a wing comprises 11 or more 2'-F. In some embodiments, a wing comprises 12 or more 2'-F. In some embodiments, a wing comprises 13 or more 2'-F. In some embodiments, a wing comprises 14 or more 2'-F. In some embodiments, a wing comprises 15 or more 2'-F. In some embodiments, a wing comprises 16 or more 2'-F. In some embodiments, a wing comprises 17 or more 2'-F. In some embodiments, a wing comprises 18 or more 2'-F. In some embodiments, a wing comprises 19 or more 2'-F. In some embodiments, a wing comprises 20 or more 2'-F. In some embodiments, a wing comprises 21 or more 2'-F. In some embodiments, a wing comprises 22 or more 2'-F. In some embodiments, a wing comprises 23 or more 2'-F. In some embodiments, a wing comprises 24 or more 2'-F. In some embodiments, a wing comprises 25 or more 2'-F. In some embodiments, a wing comprises 30 or more 2'-F. In some embodiments, a wing comprises 35 or more 2'-F.

In some embodiments, a wing comprises one 2'-F. In some embodiments, a wing comprises two 2'-F. In some embodiments, a wing comprises three 2'-F. In some embodiments, a wing comprises four 2'-F. In some embodiments, a wing comprises five 2'-F. In some embodiments, a wing comprises six 2'-F. In some embodiments, a wing comprises seven 2'-F. In some embodiments, a wing comprises eight 2'-F. In some embodiments, a wing comprises nine 2'-F. In some embodiments, a wing comprises ten 2'-F. In some embodiments, a wing comprises 11 2'-F. In some embodiments, a wing comprises 12 2'-F. In some embodiments, a wing comprises 13 2'-F. In some embodiments, a wing comprises 14 2'-F. In some embodiments, a wing comprises 15 2'-F. In some embodiments, a wing comprises 16 2'-F. In some embodiments, a wing comprises 17 2'-F. In some embodiments, a wing comprises 18 2'-F. In some embodiments, a wing comprises 19 2'-F. In some embodiments, a wing comprises 20 2'-F. In some embodiments, a wing comprises 21 2'-F. In some embodiments, a wing comprises 22 2'-F. In some embodiments, a wing comprises 23 2'-F. In some embodiments, a wing comprises 24 2'-F. In some embodiments, a wing comprises 25 2'-F. In some embodiments, a wing comprises 30 2'-F. In some embodiments, a wing comprises 35 2'-F.

In some embodiments, a wing comprises one or more consecutive 2'-F. In some embodiments, a wing comprises two or more consecutive 2'-F. In some embodiments, a wing comprises three or more consecutive 2'-F. In some embodiments, a wing comprises four or more consecutive 2'-F. In some embodiments, a wing comprises five or more consecutive 2'-F. In some embodiments, a wing comprises six or more consecutive 2'-F. In some embodiments, a wing comprises seven or more consecutive 2'-F. In some embodiments, a wing comprises eight or more consecutive 2'-F. In some embodiments, a wing comprises nine or more consecutive 2'-F. In some embodiments, a wing comprises ten or more consecutive 2'-F. In some embodiments, a wing comprises 11 or more consecutive 2'-F. In some embodiments, a wing comprises 12 or more consecutive 2'-F. In some embodiments, a wing comprises 13 or more consecutive 2'-F. In some embodiments, a wing comprises 14 or more consecutive 2'-F. In some embodiments, a wing comprises 15 or more consecutive 2'-F. In some embodiments, a wing comprises 16 or more consecutive 2'-F. In some embodiments, a wing comprises 17 or more consecutive 2'-F. In some embodiments, a wing comprises 18 or more consecutive 2'-F. In some embodiments, a wing comprises 19 or more consecutive 2'-F. In some embodiments, a wing comprises 20 or more consecutive 2'-F. In some embodiments, a wing comprises 21 or more consecutive 2'-F. In some embodiments, a wing comprises 22 or more consecutive 2'-F. In some embodiments, a wing comprises 23 or more consecutive 2'-F. In some embodiments, a wing comprises 24 or more consecutive 2'-F. In some embodiments, a wing comprises 25 or more consecutive 2'-F. In some embodiments, a wing comprises 30 or more consecutive 2'-F. In some embodiments, a wing comprises 35 or more consecutive 2'-F.

In some embodiments, a wing comprises one consecutive 2'-F. In some embodiments, a wing comprises two consecutive 2'-F. In some embodiments, a wing comprises three consecutive 2'-F. In some embodiments, a wing comprises four consecutive 2'-F. In some embodiments, a wing comprises five consecutive 2'-F. In some embodiments, a wing comprises six consecutive 2'-F. In some embodiments, a wing comprises seven consecutive 2'-F. In some embodiments, a wing comprises eight consecutive 2'-F. In some embodiments, a wing comprises nine consecutive 2'-F. In some embodiments, a wing comprises ten consecutive 2'-F. In some embodiments, a wing comprises 11 consecutive 2'-F. In some embodiments, a wing comprises 12 consecutive 2'-F. In some embodiments, a wing comprises 13 consecutive 2'-F. In some embodiments, a wing comprises 14 consecutive 2'-F. In some embodiments, a wing comprises 15 consecutive 2'-F. In some embodiments, a wing comprises 16 consecutive 2'-F. In some embodiments, a wing comprises 17 consecutive 2'-F. In some embodiments, a wing comprises 18 consecutive 2'-F. In some embodiments, a wing comprises 19 consecutive 2'-F. In some embodiments, a wing comprises 20 consecutive 2'-F. In some embodiments, a wing comprises 21 consecutive 2'-F. In some embodiments, a wing comprises 22 consecutive 2'-F. In some embodiments, a wing comprises 23 consecutive 2'-F. In some embodiments, a wing comprises 24 consecutive 2'-F. In some embodiments, a wing comprises 25 consecutive 2'-F. In some embodiments, a wing comprises 30 consecutive 2'-F. In some embodiments, a wing comprises 35 consecutive 2'-F.

In some embodiments, a wing-core-wing (i.e., X-Y-X) motif is represented numerically as, e.g., 5-10-4, meaning the wing to the 5'-end of the core is 5 bases in length, the core region is 10 bases in length, and the wing region to the 3'-end of the core is 4-bases in length. In some embodiments, a wing-core-wing motif is any of, e.g. 2-16-2, 3-14-3, 4-12-4, 5-10-5, 2-9-6, 3-9-3, 3-9-4, 3-9-5, 4-7-4, 4-9-3, 4-9-4, 4-9-5, 4-10-5, 4-11-4, 4-11-5, 5- 7-5, 5-8-6, 8-7-5, 7-7-6, 5-9-3, 5-9-5, 5-10-4, 5-10-5, 6-7-6, 6-8-5, and 6-9-2, etc. In certain embodiments, a wing-core-wing motif is 5-10-5. In certain embodiments, a wing-core-wing motif is 7-7-6. In certain embodiments, a wing-core-wing motif is 8-7-5.

In some embodiments, a wing-core motif is 5-15, 6-14, 7-13, 8-12, 9-12, etc. In some embodiments, a core-wing motif is 5-15, 6-14, 7-13, 8-12, 9-12, etc.

In some embodiments, the internucleosidic linkages of provided oligonucleotides of such wing-core-wing (i.e., X-Y-X) motifs are all chiral, modified phosphate linkages. In some embodiments, the internucleosidic linkages of provided oligonucleotides of such wing-core-wing (i.e., X-Y-X) motifs are all chiral phosphorothioate internucleotidic linkages. In some embodiments, chiral internucleotidic linkages of provided oligonucleotides of such wing-core-wing motifs are at least about 10, 20, 30, 40, 50, 50, 70, 80, or 90% chiral, modified phosphate internucleotidic linkages. In some embodiments, chiral internucleotidic linkages of provided oligonucleotides of such wing-core-wing motifs are at least about 10, 20, 30, 40, 50, 60, 70, 80, or 90% chiral phosphorothioate internucleotidic linkages. In some embodiments, chiral internucleotidic linkages of provided oligonucleotides of such wing-core-wing motifs are at least about 10, 20, 30, 40, 50, 50, 70, 80, or 90% chiral phosphorothioate internucleotidic linkages of the Sp conformation.

In some embodiments, each wing region of a wing-core-wing motif optionally contains chiral, modified phosphate internucleotidic linkages. In some embodiments, each wing region of a wing-core-wing motif optionally contains chiral phosphorothioate internucleotidic linkages. In some embodiments, each wing region of a wing-core-wing motif contains chiral phosphorothioate internucleotidic linkages. In some embodiments, the two wing regions of a wing-core-wing motif have the same internucleotidic linkage stereochemistry. In some embodiments, the two wing regions have different internucleotidic linkage stereochemistry. In some embodiments, each internucleotidic linkage in the wings is independently a chiral internucleotidic linkage.

In some embodiments, a core region of a wing-core-wing motif optionally contains chiral, modified phosphate internucleotidic linkages. In some embodiments, a core region of a wing-core-wing motif optionally contains chiral phosphorothioate internucleotidic linkages. In some embodiments, a core region of a wing-core-wing motif comprises a repeating pattern of internucleotidic linkage stereochemistry. In some embodiments, a core region of a wing-core-wing motif has a repeating pattern of internucleotidic linkage stereochemistry. In some embodiments, a core region of a wing-core-wing motif comprises repeating pattern of internucleotidic linkage stereochemistry, wherein the repeating pattern is (Sp)mRp or Rp(Sp)m, wherein m is 1-50. In some embodiments, a core region of a wing-core-wing motif comprises repeating pattern of internucleotidic linkage stereochemistry, wherein the repeating pattern is (Sp)mRp or Rp(Sp)m, wherein m is 1-50. In some embodiments, a core region of a wing-core-wing motif comprises repeating pattern of internucleotidic linkage stereochemistry, wherein the repeating pattern is (Sp)mRp, wherein m is 1-50. In some embodiments, a core region of a wing-core-wing motif comprises repeating pattern of internucleotidic linkage stereochemistry, wherein the repeating pattern is Rp(Sp)m, wherein m is 1-50. In some embodiments, a core region of a wing-core-wing motif has repeating pattern of internucleotidic linkage stereochemistry, wherein the repeating pattern is (Sp)mRp or Rp(Sp)m, wherein m is 1-50. In some embodiments, a core region of a wing-core-wing motif has repeating pattern of internucleotidic linkage stereochemistry, wherein the repeating pattern is (Sp)mRp, wherein m is 1-50. In some embodiments, a core region of a wing-core-wing motif has repeating pattern of internucleotidic linkage stereochemistry, wherein the repeating pattern is Rp(Sp)m, wherein m is 1-50. In some embodiments, a core region of a wing-core-wing motif has repeating pattern of internucleotidic linkage stereochemistry, wherein the repeating pattern is a motif comprising at least 33% of internucleotidic linkage in the S conformation. In some embodiments, a core region of a wing-core-wing motif has repeating pattern of internucleotidic linkage stereochemistry, wherein the repeating pattern is a motif comprising at least 50% of internucleotidic linkage in the S conformation. In some embodiments, a core region of a wing-core-wing motif has repeating pattern of internucleotidic linkage stereochemistry, wherein the repeating pattern is a motif comprising at least 66% of internucleotidic linkage in the S conformation. In some embodiments, a core region of a wing-core-wing motif has repeating pattern of internucleotidic linkage stereochemistry, wherein the repeating pattern is a repeating triplet motif selected from RpRpSp and SpSpRp. In some embodiments, a core region of a wing-core-wing motif has repeating pattern of internucleotidic linkage stereochemistry, wherein the repeating pattern is a repeating RpRpSp. In some embodiments, a core region of a wing-core-wing motif has repeating pattern of internucleotidic linkage stereochemistry, wherein the repeating pattern is a repeating SpSpRp.

In some embodiments, the present disclosure provides a chirally controlled oligonucleotide composition of an oligonucleotide type whose pattern of backbone chiral centers in the core region comprises (Sp)mRp or Rp(Sp)m. In some embodiments, the present disclosure provides a chirally controlled oligonucleotide composition of an oligonucleotide type whose pattern of backbone chiral centers in the core region comprises Rp(Sp)m. In some embodiments, the present disclosure provides a chirally controlled oligonucleotide composition of an oligonucleotide type whose pattern of backbone chiral centers in the core region comprises (Sp)mRp. In some embodiments, m is 2. In some embodiments, the present disclosure provides a chirally controlled oligonucleotide composition of an oligonucleotide type whose pattern of backbone chiral centers in the core region comprises $Rp(Sp)_2$. In some embodiments, the present disclosure provides a chirally controlled oligonucleotide composition of an oligonucleotide type whose pattern of backbone chiral centers in the core region comprises $(Sp)_2Rp(Sp)_2$. In some embodiments, the present disclosure provides a chirally controlled oligonucleotide composition of an oligonucleotide type whose pattern of backbone chiral centers in the core region comprises $(Rp)_2Rp(Sp)_2$. In some embodiments, the present disclosure provides a chirally controlled oligonucleotide composition of an oligonucleotide type whose pattern of backbone chiral centers in the core region comprises $RpSpRp(Sp)_2$. In some embodiments, the present disclosure provides a chirally controlled oligonucleotide composition of an oligonucleotide type whose pattern of backbone chiral centers in the core region comprises $SpRpRp(Sp)_2$. In some embodiments, the present disclosure provides a chirally controlled oligonucleotide composition of an oligonucleotide type whose pattern of backbone chiral centers in the core region comprises $(Sp)_2Rp$.

In some embodiments, the present disclosure provides a chirally controlled oligonucleotide composition of an oligonucleotide type whose pattern of backbone chiral centers comprises (Sp)mRp or Rp(Sp)m. In some embodiments, the present disclosure provides a chirally controlled oligonucleotide composition of an oligonucleotide type whose pattern of backbone chiral centers comprises Rp(Sp)m. In some embodiments, the present disclosure provides a chirally controlled oligonucleotide composition of an oligonucleotide type whose pattern of backbone chiral centers comprises (Sp)mRp. In some embodiments, m is 2. In some embodiments, the present disclosure provides a chirally controlled oligonucleotide composition of an oligonucleotide type whose pattern of backbone chiral centers comprises $Rp(Sp)_2$. In some embodiments, the present disclosure provides a chirally controlled oligonucleotide composition of an oligonucleotide type whose pattern of backbone chiral centers comprises $(Sp)_2Rp(Sp)_2$. In some embodiments, the present disclosure provides a chirally controlled oligonucleotide composition of an oligonucleotide type whose pattern of backbone chiral centers comprises $(Rp)_2Rp(Sp)_2$. In some embodiments, the present disclosure provides a chirally controlled oligonucleotide composition of an oligonucleotide type whose pattern of backbone chiral centers comprises $RpSpRp(Sp)_2$. In some embodiments, the present disclosure provides a chirally controlled oligonucleotide composition of an oligonucleotide type whose pattern of backbone chiral centers comprises $SpRpRp(Sp)_2$. In some embodiments, the present disclosure provides a chirally controlled oligonucleotide composition of an oligonucleotide type whose pattern of backbone chiral centers comprises $(Sp)_2Rp$.

As defined herein, m is 1-50. In some embodiments, m is 1. In some embodiments, m is 2-50. In some embodiments, m is 2, 3, 4, 5, 6, 7 or 8. In some embodiments, m is 3, 4, 5, 6, 7 or 8. In some embodiments, m is 4, 5, 6, 7 or 8. In some embodiments, m is 5, 6, 7 or 8. In some embodiments, m is 6, 7 or 8. In some embodiments, m is 7 or 8. In some embodiments, m is 2. In some embodiments, m is 3. In some embodiments, m is 4. In some embodiments, m is 5. In some embodiments, m is 6. In some embodiments, m is 7. In some embodiments, m is 8. In some embodiments, m is 9. In some embodiments, m is 10. In some embodiments, m is 11. In some embodiments, m is 12. In some embodiments, m is 13. In some embodiments, m is 14. In some embodiments, m is 15. In some embodiments, m is 16. In some embodiments, m is 17. In some embodiments, m is 18. In some embodiments, m is 19. In some embodiments, m is 20. In some embodiments, m is 21. In some embodiments, m is 22. In some embodiments, m is 23. In some embodiments, m is 24. In some embodiments, m is 25. In some embodiments, m is greater than 25.

In some embodiments, a repeating pattern is (Sp)m(Rp)n, wherein n is 1-10, and m is independently as defined above and described herein. In some embodiments, the present disclosure provides a chirally controlled oligonucleotide composition of an oligonucleotide type whose pattern of backbone chiral centers comprises (Sp)m(Rp)n. In some embodiments, the present disclosure provides a chirally controlled oligonucleotide composition of an oligonucleotide type whose pattern of backbone chiral centers in the core region comprises (Sp)m(Rp)n. In some embodiments, a repeating pattern is (Rp)n(Sp)m, wherein n is 1-10, and m is independently as defined above and described herein. In some embodiments, the present disclosure provides a chirally controlled oligonucleotide composition of an oligonucleotide type whose pattern of backbone chiral centers comprises (Rp)n(Sp)m. In some embodiments, the present disclosure provides a chirally controlled oligonucleotide composition of an oligonucleotide type whose pattern of backbone chiral centers in the core region comprises (Rp)n(Sp)m. In some embodiments, (Rp)n(Sp)m is $(Rp)(Sp)_2$. In some embodiments, (Sp)n(Rp)m is $(Sp)_2(Rp)$.

In some embodiments, the present disclosure provides a chirally controlled oligonucleotide composition of an oligonucleotide type whose pattern of backbone chiral centers comprises (Sp)m(Rp)n(Sp)t. In some embodiments, a repeating pattern is (Sp)m(Rp)n(Sp)t, wherein n is 1-10, t is 1-50, and m is as defined above and described herein. In some embodiments, the present disclosure provides a chirally controlled oligonucleotide composition of an oligonucleotide type whose pattern of backbone chiral centers in the core region comprises (Sp)m(Rp)n(Sp)t. In some embodiments, a repeating pattern is (Sp)t(Rp)n(Sp)m, wherein n is 1-10, t is 1-50, and m is as defined above and described herein. In some embodiments, the present disclosure provides a chirally controlled oligonucleotide composition of an oligonucleotide type whose pattern of backbone chiral centers comprises (Sp)t(Rp)n(Sp)m. In some embodiments, the present disclosure provides a chirally controlled oligonucleotide composition of an oligonucleotide type whose pattern of backbone chiral centers in the core region comprises (Sp)t(Rp)n(Sp)m.

In some embodiments, a repeating pattern is (Np)t(Rp)n(Sp)m, wherein n is 1-10, t is 1-50, Np is independently Rp or Sp, and m is as defined above and described herein. In some embodiments, the present disclosure provides a chirally controlled oligonucleotide composition of an oligonucleotide type whose pattern of backbone chiral centers comprises (Np)t(Rp)n(Sp)m. In some embodiments, the present disclosure provides a chirally controlled oligonucleotide composition of an oligonucleotide type whose pattern of backbone chiral centers in the core region comprises (Np)t(Rp)n(Sp)m. In some embodiments, a repeating pattern is (Np)m(Rp)n(Sp)t, wherein n is 1-10, t is 1-50, Np is independently Rp or Sp, and m is as defined above and described herein. In some embodiments, the present disclosure provides a chirally controlled oligonucleotide composition of an oligonucleotide type whose pattern of backbone chiral centers comprises (Np)m(Rp)n(Sp)t. In some embodiments, the present disclosure provides a chirally controlled oligonucleotide composition of an oligonucleotide type whose pattern of backbone chiral centers in the core region comprises (Np)m(Rp)n(Sp)t. In some embodiments, Np is Rp. In some embodiments, Np is Sp. In some embodiments, all Np are the same. In some embodiments, all Np are Sp. In some embodiments, at least one Np is different from the other Np. In some embodiments, t is 2.

As defined herein, n is 1-10. In some embodiments, n is 1, 2, 3, 4, 5, 6, 7 or 8. In some embodiments, n is 1. In some embodiments, n is 2, 3, 4, 5, 6, 7 or 8. In some embodiments, n is 3, 4, 5, 6, 7 or 8. In some embodiments, n is 4, 5, 6, 7 or 8. In some embodiments, n is 5, 6, 7 or 8. In some embodiments, n is 6, 7 or 8. In some embodiments, n is 7 or 8. In some embodiments, n is 1. In some embodiments, n is 2. In some embodiments, n is 3. In some embodiments, n is 4. In some embodiments, n is 5. In some embodiments, n is 6. In some embodiments, n is 7. In some embodiments, n is 8. In some embodiments, n is 9. In some embodiments, n is 10.

As defined herein, t is 1-50. In some embodiments, t is 1. In some embodiments, t is 2-50. In some embodiments, t is 2, 3, 4, 5, 6, 7 or 8. In some embodiments, t is 3, 4, 5, 6, 7 or 8. In some embodiments, t is 4, 5, 6, 7 or 8. In some embodiments, t is 5, 6, 7 or 8. In some embodiments, t is 6, 7 or 8. In some embodiments, t is 7 or 8. In some embodiments, t is 2. In some embodiments, t is 3. In some embodiments, t is 4. In some embodiments, t is 5. In some embodiments, t is 6. In some embodiments, t is 7. In some embodiments, t is 8. In some embodiments, t is 9. In some embodiments, t is 10. In some embodiments, t is 11. In some embodiments, t is 12. In some embodiments, t is 13. In some embodiments, t is 14. In some embodiments, t is 15. In some embodiments, t is 16. In some embodiments, t is 17. In some embodiments, t is 18. In some embodiments, t is 19. In some embodiments, t is 20. In some embodiments, t is 21. In some embodiments, t is 22. In some embodiments, t is 23. In some embodiments, t is 24. In some embodiments, t is 25. In some embodiments, t is greater than 25.

In some embodiments, at least one of m and t is greater than 2. In some embodiments, at least one of m and t is greater than 3. In some embodiments, at least one of m and t is greater than 4. In some embodiments, at least one of m and t is greater than 5. In some embodiments, at least one of m and t is greater than 6. In some embodiments, at least one of m and t is greater than 7. In some embodiments, at least one of m and t is greater than 8. In some embodiments, at least one of m and t is greater than 9. In some embodiments, at least one of m and t is greater than 10. In some embodiments, at least one of m and t is greater than 11. In some embodiments, at least one of m and t is greater than 12. In some embodiments, at least one of m and t is greater than 13. In some embodiments, at least one of m and t is greater than 14. In some embodiments, at least one of m and t is greater than 15. In some embodiments, at least one of m and t is greater than 16. In some embodiments, at least one of m and t is greater than 17. In some embodiments, at least one of m and t is greater than 18. In some embodiments, at least one of m and t is greater than 19. In some embodiments, at least one of m and t is greater than 20. In some embodiments, at least one of m and t is greater than 21. In some embodiments, at least one of m and t is greater than 22. In some embodiments, at least one of m and t is greater than 23. In some embodiments, at least one of m and t is greater than 24. In some embodiments, at least one of m and t is greater than 25.

In some embodiments, each one of m and t is greater than 2. In some embodiments, each one of m and t is greater than 3. In some embodiments, each one of m and t is greater than 4. In some embodiments, each one of m and t is greater than 5. In some embodiments, each one of m and t is greater than 6. In some embodiments, each one of m and t is greater than 7. In some embodiments, each one of m and t is greater than 8. In some embodiments, each one of m and t is greater than 9. In some embodiments, each one of m and t is greater than 10. In some embodiments, each one of m and t is greater than 11. In some embodiments, each one of m and t is greater than 12. In some embodiments, each one of m and t is greater than 13. In some embodiments, each one of m and t is greater than 14. In some embodiments, each one of m and t is greater than 15. In some embodiments, each one of m and t is greater than 16. In some embodiments, each one of m and t is greater than 17. In some embodiments, each one of m and t is greater than 18. In some embodiments, each one of m and t is greater than 19. In some embodiments, each one of m and t is greater than 20.

In some embodiments, the sum of m and t is greater than 3. In some embodiments, the sum of m and t is greater than 4. In some embodiments, the sum of m and t is greater than 5. In some embodiments, the sum of m and t is greater than 6. In some embodiments, the sum of m and t is greater than 7. In some embodiments, the sum of m and t is greater than 8. In some embodiments, the sum of m and t is greater than 9. In some embodiments, the sum of m and t is greater than 10. In some embodiments, the sum of m and t is greater than 11. In some embodiments, the sum of m and t is greater than 12. In some embodiments, the sum of m and t is greater than 13. In some embodiments, the sum of m and t is greater than 14. In some embodiments, the sum of m and t is greater than 15. In some embodiments, the sum of m and t is greater than 16. In some embodiments, the sum of m and t is greater than 17. In some embodiments, the sum of m and t is greater than 18. In some embodiments, the sum of m and t is greater than 19. In some embodiments, the sum of m and t is greater than 20. In some embodiments, the sum of m and t is greater than 21. In some embodiments, the sum of m and t is greater than 22. In some embodiments, the sum of m and t is greater than 23. In some embodiments, the sum of m and t is greater than 24. In some embodiments, the sum of m and t is greater than 25.

In some embodiments, n is 1, and at least one of m and t is greater than 1. In some embodiments, n is 1 and each of m and t is independently greater than 1. In some embodiments, m>n and t>n. In some embodiments, (Sp)m(Rp)n (Sp)t is $(Sp)_2Rp(Sp)_2$. In some embodiments, (Sp)t(Rp)n (Sp)m is $(Sp)_2Rp(Sp)_2$. In some embodiments, (Sp)t(Rp)n (Sp)m is $SpRp(Sp)_2$. In some embodiments, (Np)t(Rp)n (Sp)m is (Np)tRp(Sp)m. In some embodiments, (Np)t(Rp) n(Sp)m is $(Np)_2Rp(Sp)m$. In some embodiments, (Np)t(Rp) n(Sp)m is $(Rp)_2Rp(Sp)m$. In some embodiments, (Np)t(Rp) n(Sp)m is $(Sp)_2Rp(Sp)m$. In some embodiments, (Np)t(Rp) n(Sp)m is RpSpRp(Sp)m. In some embodiments, (Np)t(Rp) n(Sp)m is SpRpRp(Sp)m.

In some embodiments, (Sp)t(Rp)n(Sp)m is SpRpSpSp. In some embodiments, (Sp)t(Rp)n(Sp)m is $(Sp)_2Rp(Sp)_2$. In some embodiments, (Sp)t(Rp)n(Sp)m is $(Sp)_3Rp(Sp)_3$. In some embodiments, (Sp)t(Rp)n(Sp)m is $(Sp)_4Rp(Sp)_4$. In some embodiments, (Sp)t(Rp)n(Sp)m is $(Sp)tRp(Sp)_5$. In some embodiments, (Sp)t(Rp)n(Sp)m is $SpRp(Sp)_5$. In some embodiments, (Sp)t(Rp)n(Sp)m is $(Sp)_2Rp(Sp)_5$. In some embodiments, (Sp)t(Rp)n(Sp)m is $(Sp)_3Rp(Sp)_5$. In some embodiments, (Sp)t(Rp)n(Sp)m is $(Sp)_4Rp(Sp)_5$. In some embodiments, (Sp)t(Rp)n(Sp)m is $(Sp)_5Rp(Sp)_5$.

In some embodiments, (Sp)m(Rp)n(Sp)t is $(Sp)_2Rp(Sp)_2$. In some embodiments, (Sp)m(Rp)n(Sp)t is $(Sp)_3Rp(Sp)_3$. In some embodiments, (Sp)m(Rp)n(Sp)t is $(Sp)_4Rp(Sp)_4$. In some embodiments, (Sp)m(Rp)n(Sp)t is $(Sp)mRp(Sp)_5$. In some embodiments, (Sp)m(Rp)n(Sp)t is $(Sp)_2Rp(Sp)_5$. In some embodiments, (Sp)m(Rp)n(Sp)t is $(Sp)_3Rp(Sp)_5$. In some embodiments, (Sp)m(Rp)n(Sp)t is $(Sp)_4Rp(Sp)_5$. In some embodiments, (Sp)m(Rp)n(Sp)t is $(Sp)_5Rp(Sp)_5$.

In some embodiments, a core region comprises at least one Rp internucleotidic linkage. In some embodiments, a core region of a wing-core-wing motif comprises at least one Rp internucleotidic linkage. In some embodiments, a core region comprises at least one Rp phosphorothioate internucleotidic linkage. In some embodiments, a core region of a wing-core-wing motif comprises at least one Rp phosphorothioate internucleotidic linkage. In some embodiments, a core region of a wing-core-wing motif comprises only one Rp phosphorothioate internucleotidic linkage. In some embodiments, a core region motif comprises at least two Rp internucleotidic linkages. In some embodiments, a core region of a wing-core-wing motif comprises at least two Rp internucleotidic linkages. In some embodiments, a core region of a wing-core-wing motif comprises at least two Rp phosphorothioate internucleotidic linkages. In some embodiments, a core region comprises at least three Rp internucleotidic linkages. In some embodiments, a core region of a wing-core-wing motif comprises at least three Rp internucleotidic linkages. In some embodiments, a core region comprises at least three Rp phosphorothioate internucleotidic linkages. In some embodiments, a core region of a wing-core-wing motif comprises at least three Rp phosphorothioate internucleotidic linkages. In some embodiments, a core region comprises at least 4, 5, 6, 7, 8, 9, or 10 Rp internucleotidic linkages. In some embodiments, a core region of a wing-core-wing motif comprises at least 4, 5, 6, 7, 8, 9, or 10 Rp internucleotidic linkages. In some embodiments, a core region comprises at least 4, 5, 6, 7, 8, 9, or 10 Rp phosphorothioate internucleotidic linkages. In some embodiments, a core region of a wing-core-wing motif comprises at least 4, 5, 6, 7, 8, 9, or 10 Rp phosphorothioate internucleotidic linkages.

In some embodiments, a wing region comprises 2'-modifications of sugar moieties that differ from a core region. In some embodiments, a wing region comprises the same type of 2'-modifications that differ from a core region. In some embodiments, a wing region comprises 2'-F which is absent from a core region. In some embodiments, a wing region comprises a pattern of 2'-F which is absent from a core region. In some embodiments, a wing region comprises a level of 2'-F which differs from a core region. In some embodiments, a level is absolute as measured by the number of 2'-F modifications. In some embodiments, a level is relative as measured by the percentage of 2'-F modifications. In some embodiments, a wing region differs from a core region in that it contains less of a 2'-modification presented in a core region, as measured by the number and/or percentage of such 2'-modifications. In some embodiments, a wing region contains less of a $2'-OR^1$ modification in a core region. In some embodiments, a wing region contains less of a 2'-OMe modification in a core region. In some embodiments, a wing region differs from a core region in that it contains less of unmodified sugar moieties presented in a core region, as measured by the number and/or percentage of such 2'-modifications.

In some embodiments, provided oligonucleotides comprise two or more wing regions and a core region, for example, provided oligonucleotides may comprise a wing-core-wing structure. In some embodiments, each wing region comprises 2'-modifications of sugar moieties that differ from a core region. In some embodiments, each wing region comprises the same type of 2'-modifications that differ from a core region. In some embodiments, each wing region comprises 2'-F which is absent from a core region. In some embodiments, each wing region comprises a pattern of 2'-F which is absent from a core region. In some embodiments, each wing region comprises a level of 2'-F which differs from a core region. In some embodiments, a level is absolute as measured by the number of 2'-F modifications. In some embodiments, a level is relative as measured by the percentage of 2'-F modifications. In some embodiments, each wing region differs from a core region in that it contains less of a 2'-modification presented in a core region, as measured by the number and/or percentage of such 2'-modifications. In some embodiments, each wing region contains less of a 2'-$OR^1$ modification in a core region. In some embodiments, each wing region contains less of a 2'-OMe modification in a core region. In some embodiments, each wing region differs from a core region in that it contains less of unmodified sugar moieties presented in a core region, as measured by the number and/or percentage of such 2'-modifications.

In certain embodiments, a wing-core-wing motif is a 5-10-5 motif wherein the residues at each wing region are 2'-modified residues. In certain embodiments, a wing-core-wing motif is a 5-10-5 motif wherein the residues at each wing region are 2'-$OR^1$-modified residues. In certain embodiments, a wing-core-wing motif is a 5-10-5 motif wherein the residues at each wing region are 2'-MOE-modified residues. In certain embodiments, a wing-core-wing motif is a 5-10-5 motif wherein the residues at each wing region are 2'-F-modified residues. In certain embodiments, a wing-core-wing motif is a 5-10-5 motif wherein the residues at each wing region are 2'-OMe-modified residues. In certain embodiments, a wing-core-wing motif is a 5-10-5 motif wherein the residues in the core region are 2'-deoxyribonucleoside residues. In certain embodiments, a wing-core-wing motif is a 5-10-5 motif, wherein all internucleotidic linkages are phosphorothioate linkages. In certain embodiments, a wing-core-wing motif is a 5-10-5 motif, wherein all internucleotidic linkages are chiral phosphorothioate linkages. In certain embodiments, a wing-core-wing motif is a 5-10-5 motif wherein the residues at each wing region are 2'-modified residues, the residues in the core region are 2'-deoxyribonucleoside residues, and all internucleotidic linkages in the core region are chiral phosphorothioate linkages. In certain embodiments, a wing-core-wing motif is a 5-10-5 motif wherein the residues at each wing region are 2'-$OR^1$-modified residues, the residues in the core region are 2'-deoxyribonucleoside residues, and all internucleotidic linkages in the core region are chiral phosphorothioate linkages. In certain embodiments, a wing-core-wing motif is a 5-10-5 motif wherein the residues at each wing region are 2'-MOE-modified residues, the residues in the core region are 2'-deoxyribonucleoside residues, and all internucleotidic linkages in the core region are chiral phosphorothioate linkages. In certain embodiments, a wing-core-wing motif is a 5-10-5 motif wherein the residues at each wing region are 2'-OMe-modified residues, the residues in the core region are 2'-deoxyribonucleoside residues, and all internucleotidic linkages in the core region are chiral phosphorothioate linkages.

In some embodiments, residues at the “X” wing region are not 2'-MOE-modified residues. In certain embodiments, a wing-core motif is a motif wherein the residues at the “X” wing region are not 2'-MOE-modified residues. In certain embodiments, a core-wing motif is a motif wherein the residues at the “X” wing region are not 2'-MOE-modified residues. In certain embodiments, a wing-core-wing motif is a motif wherein the residues at each “X” wing region are not 2'-MOE-modified residues. In certain embodiments, a wing-core-wing motif is a 5-10-5 motif wherein the residues at each “X” wing region are not 2'-MOE-modified residues. In certain embodiments, a wing-core-wing motif is a 5-10-5 motif wherein the residues in the core “Y” region are 2'-deoxyribonucleoside residues. In certain embodiments, a wing-core-wing motif is a 5-10-5 motif, wherein all internucleotidic linkages are phosphorothioate internucleotidic linkages. In certain embodiments, a wing-core-wing motif is a 5-10-5 motif, wherein all internucleotidic linkages are chiral phosphorothioate internucleotidic linkages. In certain embodiments, a wing-core-wing motif is a 5-10-5 motif wherein the residues at each “X” wing region are not 2'-MOE-modified residues, the residues in the core “Y” region are 2'-deoxyribonucleoside, and all internucleotidic linkages are chiral phosphorothioate internucleotidic linkages.

In some embodiments, a chiral, modified phosphate linkage is a chiral phosphorothioate linkage, i.e., phosphorothioate internucleotidic linkage. In some embodiments, a core region comprises at least 5%, 10%, 15%, 20%, 25%, 30%, 35%, 40%, 45%, 50%, 55%, 60%, 65%, 70%, 75%, 80%, 85%, 90%, 95%, or 100% chiral phosphorothioate internucleotidic linkages. In some embodiments, all chiral, modified phosphate linkages are chiral phosphorothioate internucleotidic linkages. In some embodiments, at least about 10%, 20%, 30%, 40%, 50%, 60%, 70%, 80%, or 90% chiral phosphorothioate internucleotidic linkages of a core region are of the Sp conformation. In some embodiments, at least about 10% chiral phosphorothioate internucleotidic linkages of a core region are of the Sp conformation. In some embodiments, at least about 20% chiral phosphorothioate internucleotidic linkages of a core region are of the Sp conformation. In some embodiments, at least about 30% chiral phosphorothioate internucleotidic linkages of a core region are of the Sp conformation. In some embodiments, at least about 40% chiral phosphorothioate internucleotidic linkages of a core region are of the Sp conformation. In some embodiments, at least about 50% chiral phosphorothioate internucleotidic linkages of a core region are of the Sp conformation. In some embodiments, at least about 60% chiral phosphorothioate internucleotidic linkages of a core region are of the Sp conformation. In some embodiments, at least about 70% chiral phosphorothioate internucleotidic linkages of a core region are of the Sp conformation. In some embodiments, at least about 80% chiral phosphorothioate internucleotidic linkages of a core region are of the Sp conformation. In some embodiments, at least about 90% chiral phosphorothioate internucleotidic linkages of a core region are of the Sp conformation. In some embodiments, at least about 95% chiral phosphorothioate internucleotidic linkages of a core region are of the Sp conformation.

In some embodiments, at least about 10%, 20%, 30%, 40%, 50%, 60%, 70%, 80%, or 90% chiral phosphorothioate internucleotidic linkages of a core region are of the Rp conformation. In some embodiments, at least about 10% chiral phosphorothioate internucleotidic linkages of a core region are of the Rp conformation. In some embodiments, at least about 20% chiral phosphorothioate internucleotidic linkages of a core region are of the Rp conformation. In some embodiments, at least about 30% chiral phosphorothioate internucleotidic linkages of a core region are of the Rp conformation. In some embodiments, at least about 40% chiral phosphorothioate internucleotidic linkages of a core region are of the Rp conformation. In some embodiments, at least about 50% chiral phosphorothioate internucleotidic linkages of a core region are of the Rp conformation. In some embodiments, at least about 60% chiral phosphorothioate internucleotidic linkages of a core region are of the Rp conformation. In some embodiments, at least about 70% chiral phosphorothioate internucleotidic linkages of a core region are of the Rp conformation. In some embodiments, at least about 80% chiral phosphorothioate internucleotidic linkages of a core region are of the Rp conformation. In some embodiments, at least about 90% chiral phosphorothioate internucleotidic linkages of a core region are of the Rp conformation. In some embodiments, at least about 95% chiral phosphorothioate internucleotidic linkages of a core region are of the Rp conformation.

In some embodiments, less than about 10%, 20%, 30%, 40%, 50%, 60%, 70%, 80%, or 90% chiral phosphorothioate internucleotidic linkages of a core region are of the Rp conformation. In some embodiments, less than about 10% chiral phosphorothioate internucleotidic linkages of a core region are of the Rp conformation. In some embodiments, less than about 20% chiral phosphorothioate internucleotidic linkages of a core region are of the Rp conformation. In some embodiments, less than about 30% chiral phosphorothioate internucleotidic linkages of a core region are of the Rp conformation. In some embodiments, less than about 40% chiral phosphorothioate internucleotidic linkages of a core region are of the Rp conformation. In some embodiments, less than about 50% chiral phosphorothioate internucleotidic linkages of a core region are of the Rp conformation. In some embodiments, less than about 60% chiral phosphorothioate internucleotidic linkages of a core region are of the Rp conformation. In some embodiments, less than about 70% chiral phosphorothioate internucleotidic linkages of a core region are of the Rp conformation. In some embodiments, less than about 80% chiral phosphorothioate internucleotidic linkages of a core region are of the Rp conformation. In some embodiments, less than about 90% chiral phosphorothioate internucleotidic linkages of a core region are of the Rp conformation. In some embodiments, less than about 95% chiral phosphorothioate internucleotidic linkages of a core region are of the Rp conformation. In some embodiments, a core region has only one Rp chiral phosphorothioate internucleotidic linkages. In some embodiments, a core region has only one Rp chiral phosphorothioate internucleotidic linkages, wherein all internucleotide linkages are chiral phosphorothioate internucleotidic linkages.

In some embodiments, provided oligonucleotides are blockmers. In some embodiments, provided oligonucleotide are altmers. In some embodiments, provided oligonucleotides are altmers comprising alternating blocks. In some embodiments, a blockmer or an altmer can be defined by chemical modifications (including presence or absence), e.g., base modifications, sugar modification, internucleotidic linkage modifications, stereochemistry, etc. Example chemical modifications, stereochemistry and patterns thereof for a block and/or an alternating unit include but are not limited to those described in this disclosure, such as those described for a wing, a core, an oligonucleotide, etc. In some embodiments, a blockmer comprises a pattern of . . . SS . . . RR . . . SS . . . RR . . . In some embodiments, an altmer comprises a pattern of SRSRSRSR.

In some embodiments, a pattern of backbone chiral center, e.g., of a wing, a core, a block, comprises one or more (Rp)p(Sp)x(Rp)q(Sp)y, wherein each of p, x, q, y is independently 0-50, p+q>0, and x+y>0.

In some embodiments, a provided pattern of backbone chiral centers comprises repeating (Sp)m(Rp)n, (Rp)n(Sp)m, (Np)t(Rp)n(Sp)m, or (Sp)t(Rp)n(Sp)m units. In some embodiments, a repeating unit is (Sp)m(Rp)n. In some embodiments, a repeating unit is SpRp. In some embodiments, a repeating unit is SpSpRp. In some embodiments, a repeating unit is SpRpRp. In some embodiments, a repeating unit is RpRpSp. In some embodiments, a repeating unit is (Rp)n(Sp)m. In some embodiments, a repeating unit is (Np)t(Rp)n(Sp)m. In some embodiments, a repeating unit is (Sp)t(Rp)n(Sp)m.

In some embodiments, a provided pattern of backbone chiral centers comprises (Rp/Sp)x-(All Rp or All Sp)-(Rp/Sp)y. In some embodiments, a provided pattern of backbone chiral centers comprises (Rp/Sp)-(All Rp or All Sp)-(Rp/Sp). In some embodiments, a provided pattern of backbone chiral centers comprises (Rp)x-(All Sp)-(Rp)y. In some embodiments, a provided pattern of backbone chiral centers comprises (Rp)-(All Sp)-(Rp). In some embodiments, a provided pattern of backbone chiral centers comprises (Sp)x-(All Rp)-(Sp)y. In some embodiments, a provided pattern of backbone chiral centers comprises (Sp)-(All Rp)-(Sp). In some embodiments, a provided pattern of backbone chiral centers comprises (Rp/Sp)x-(repeating (Sp)m(Rp)n)-(Rp/Sp)y. In some embodiments, a provided pattern of backbone chiral centers comprises (Rp/Sp)-(repeating (Sp)m(Rp)n)-(Rp/Sp). In some embodiments, a provided pattern of backbone chiral centers comprises (Rp/Sp)x-(repeating SpSpRp)-(Rp/Sp)y. In some embodiments, a provided pattern of backbone chiral centers comprises (Rp/Sp)-(repeating SpSpRp)-(Rp/Sp).

In some embodiments, a provided pattern of backbone chiral centers is (Rp/Sp)x-(All Rp or All Sp)-(Rp/Sp)y. In some embodiments, a provided pattern of backbone chiral centers is (Rp/Sp)-(All Rp or All Sp)-(Rp/Sp). In some embodiments, a provided pattern of backbone chiral centers is (Rp)x-(All Sp)-(Rp)y. In some embodiments, a provided pattern of backbone chiral centers is (Rp)-(All Sp)-(Rp). In some embodiments, a provided pattern of backbone chiral centers is (Sp)x-(All Rp)-(Sp)y. In some embodiments, a provided pattern of backbone chiral centers is (Sp)-(All Rp)-(Sp). In some embodiments, a provided pattern of backbone chiral centers is (Rp/Sp)x-(repeating (Sp)m(Rp)n)-(Rp/Sp)y. In some embodiments, a provided pattern of backbone chiral centers is (Rp/Sp)-(repeating (Sp)m(Rp)n)-(Rp/Sp). In some embodiments, a provided pattern of backbone chiral centers is (Rp/Sp)x-(repeating SpSpRp)-(Rp/Sp)y. In some embodiments, a provided pattern of backbone chiral centers is (Rp/Sp)-(repeating SpSpRp)-(Rp/Sp).

A person of ordinary skill in the art understands that various regions of a target transcript can be targeted by provided compositions and methods. In some embodiments, a base sequence of provided oligonucleotides comprises an intron sequence. In some embodiments, a base sequence of provided oligonucleotides comprises an exon sequence. In some embodiments, a base sequence of provided oligonucleotides comprises an intron and an exon sequence. In some embodiments, a base sequence of provided oligonucleotides comprises a sequence spanning a splicing site. In some embodiments, a base sequence of provided oligonucleotides comprises a sequence found in or comprising a 5' splice site, a branch point sequence (BPS), a polypyrimidine tact (py tact), a 3' splice site, an intronic splicing silencer (ISS), an exonic splicing silencer (ESS), an intronic splicing enhancer (ISE), and/or an exonic splicing enhancer. In some embodiments, a base sequence of provided oligonucleotides is an intron sequence. In some embodiments, a base sequence of provided oligonucleotides is an exon sequence. In some embodiments, a base sequence of provided oligonucleotides is a sequence spanning a splicing site. In some embodiments, a base sequence of provided oligonucleotides is a sequence found in or comprising a 5' splice site, a branch point sequence (BPS), a polypyrimidine tact (py tact), a 3' splice site, an intronic splicing silencer (ISS), an exonic splicing silencer (ESS), an intronic splicing enhancer (ISE), and/or an exonic splicing enhancer. In some embodiments, a base sequence of provided oligonucleotides is a sequence found in a branch point sequence (BPS), a polypyrimidine tact (py tact), an intronic splicing silencer (ISS), an exonic splicing silencer (ESS), an intronic splicing enhancer (ISE), and/or an exonic splicing enhancer.

As understood by a person having ordinary skill in the art, provided oligonucleotides and compositions, among other things, can target a great number of nucleic acid polymers. For instance, in some embodiments, provided oligonucleotides and compositions may target a transcript of a nucleic acid sequence, wherein a common base sequence of oligonucleotides (e.g., a base sequence of an oligonucleotide type) comprises or is a sequence complementary to a sequence of the transcript. In some embodiments, a common base sequence comprises a sequence complimentary to a sequence of a target. In some embodiments, a common base sequence is a sequence complimentary to a sequence of a target. In some embodiments, a common base sequence comprises or is a sequence 100% complimentary to a sequence of a target. In some embodiments, a common base sequence comprises a sequence 100% complimentary to a sequence of a target. In some embodiments, a common base sequence is a sequence 100% complimentary to a sequence of a target. In some embodiments, a common base sequence in a core comprises or is a sequence complimentary to a sequence of a target. In some embodiments, a common base sequence in a core comprises a sequence complimentary to a sequence of a target. In some embodiments, a common base sequence in a core is a sequence % complimentary to a sequence of a target. In some embodiments, a common base sequence in a core comprises or is a sequence 100% complimentary to a sequence of a target. In some embodiments, a common base sequence in a core comprises a sequence 100% complimentary to a sequence of a target. In some embodiments, a common base sequence in a core is a sequence 100% complimentary to a sequence of a target.

In some embodiments, as described in this disclosure, provided oligonucleotides and compositions may provide new cleavage patterns, higher cleavage rate, higher cleavage degree, higher cleavage selectivity, etc. In some embodiments, provided compositions can selectively suppress (e.g., cleave) a transcript from a target nucleic acid sequence which has one or more similar sequences exist within a subject or a population, each of the target and its similar sequences contains a specific nucleotidic characteristic sequence element that defines the target sequence relative to the similar sequences. In some embodiments, for example, a target sequence is a wild-type allele or copy of a gene, and a similar sequence is a sequence has very similar base sequence, e.g., a sequence having SNP, mutations, etc.; In some embodiments, a characteristic sequence element defines that target sequence relative to the similar sequence: for example, when a target sequence is a Huntington's disease-causing allele with T at rs362307 (U in the corresponding RNA; C for the non-disease-causing allele), a characteristic sequence comprises this SNP.

In some embodiments, a similar sequence has greater than 60%, 65%, 70%, 75%, 80%, 85%, 90%, 91%, 92%, 93%, 94%, 95%, 96%, 97%, 98% or 99% sequence homology with a target sequence. In some embodiments, a target sequence is a disease-causing copy of a nucleic acid sequence comprising one or more mutations and/or SNPs, and a similar sequence is a copy not causing the disease (wild type). In some embodiments, a target sequence comprises a mutation, wherein a similar sequence is the corresponding wild-type sequence. In some embodiments, a target sequence is a mutant allele, while a similar sequence is a wild-type allele. In some embodiments, a target sequence comprises an SNP that is associated with a disease-causing allele, while a similar sequence comprises the same SNP that is not associates with the disease-causing allele. In some embodiments, the region of a target sequence that is complementary to a common base sequence of a provided oligonucleotide composition has greater than 60%, 65%, 70%, 75%, 80%, 85%, 90%, 91%, 92%, 93%, 94%, 95%, 96%, 97%, 98% or 99% sequence homology with the corresponding region of a similar sequence. In some embodiments, the region of a target sequence that is complementary to a common base sequence of a provided oligonucleotide composition differs from the corresponding region of a similar sequence at less than 5, less than 4, less than 3, less than 2, or only 1 base pairs. In some embodiments, the region of a target sequence that is complementary to a common base sequence of a provided oligonucleotide composition differs from the corresponding region of a similar sequence only at a mutation site or SNP site. In some embodiments, the region of a target sequence that is complementary to a common base sequence of a provided oligonucleotide composition differs from the corresponding region of a similar sequence only at a mutation site. In some embodiments, the region of a target sequence that is complementary to a common base sequence of a provided oligonucleotide composition differs from the corresponding region of a similar sequence only at an SNP site.

In some embodiments, a common base sequence comprises or is a sequence complementary to a characteristic sequence element. In some embodiments, a common base sequence comprises a sequence complementary to a characteristic sequence element. In some embodiments, a common base sequence is a sequence complementary to a characteristic sequence element. In some embodiments, a common base sequence comprises or is a sequence 100% complementary to a characteristic sequence element. In some embodiments, a common base sequence comprises a sequence 100% complementary to a characteristic sequence element. In some embodiments, a common base sequence is a sequence 100% complementary to a characteristic sequence element. In some embodiments, a common base sequence in a core comprises or is a sequence complementary to a characteristic sequence element. In some embodiments, a common base sequence in a core comprises a sequence complementary to a characteristic sequence element. In some embodiments, a common base sequence in a core is a sequence complementary to a characteristic sequence element. In some embodiments, a common base sequence in a core comprises or is a sequence 100% complementary to a characteristic sequence element. In some embodiments, a common base sequence in a core comprises a sequence 100% complementary to a characteristic sequence element. In some embodiments, a common base sequence in a core is a sequence 100% complementary to a characteristic sequence element.

In some embodiments, a characteristic sequence element comprises or is a mutation. In some embodiments, a characteristic sequence element comprises a mutation. In some embodiments, a characteristic sequence element is a mutation. In some embodiments, a characteristic sequence element comprises or is a point mutation. In some embodiments, a characteristic sequence element comprises a point mutation. In some embodiments, a characteristic sequence element is a point mutation. In some embodiments, a characteristic sequence element comprises or is an SNP. In some embodiments, a characteristic sequence element comprises an SNP. In some embodiments, a characteristic sequence element is an SNP.

In some embodiments, a common base sequence 100% matches a target sequence, which it does not 100% match a similar sequence of the target sequence. For example, in some embodiments, a common base sequence matches a mutation in the disease-causing copy or allele of a target nucleic acid sequence, but does not match a non-disease-causing copy or allele at the mutation site; in some other embodiments, a common base sequence matches an SNP in the disease-causing allele of a target nucleic acid sequence, but does not match a non-disease-causing allele at the corresponding site. In some embodiments, a common base sequence in a core 100% matches a target sequence, which it does not 100% match a similar sequence of the target sequence. For example, in WV-1092, its common base sequence (and its common base sequence in its core) matches the disease-causing U, but not the non-disease causing (wild-type) C at rs362307.

Among other things, the present disclosure recognizes that a base sequence may have impact on oligonucleotide properties. In some embodiments, a base sequence may have impact on cleavage pattern of a target when oligonucleotides having the base sequence are utilized for suppressing a target, e.g., through a pathway involving RNase H: for example, structurally similar (all phosphorothioate linkages, all stereorandom) oligonucleotides have different sequences may have different cleavage patterns. In some embodiments, a common base sequence of a non-stereorandom oligonucleotide compositions (e.g., certain oligonucleotide compositions provided in the present disclosure) is a base sequence that when applied to a DNA oligonucleotide composition (e.g., ONT-415) or a stereorandom all-phosphorothioate oligonucleotide composition (e.g., WV-905), cleavage pattern of the DNA (DNA cleavage pattern) and/or the stereorandom all-phosphorothioate (stereorandom cleavage pattern) composition has a cleavage site within or in the vicinity of a characteristic sequence element. In some embodiments, a cleavage site within or in the vicinity is within a sequence complementary to a core region of a common sequence. In some embodiments, a cleavage site within or in the vicinity is within a sequence 100% complementary to a core region of a common sequence.

In some embodiments, a common base sequence is a base sequence that has a cleavage site within or in the vicinity of a characteristic sequence element in its DNA cleavage pattern. In some embodiments, a common base sequence is a base sequence that has a cleavage site within a characteristic sequence element in its DNA cleavage pattern. In some embodiments, a common base sequence is a base sequence that has a cleavage site in the vicinity of a characteristic sequence element in its DNA cleavage pattern. In some embodiments, a common base sequence is a base sequence that has a cleavage site in the vicinity of a mutation or SNP of a characteristic sequence element in its DNA cleavage pattern. In some embodiments, a common base sequence is a base sequence that has a cleavage site in the vicinity of a mutation in its DNA cleavage pattern. In some embodiments, a common base sequence is a base sequence that has a cleavage site in the vicinity of an SNP in its DNA cleavage pattern.

In some embodiments, a common base sequence is a base sequence that has a cleavage site within or in the vicinity of a characteristic sequence element in its stereorandom cleavage pattern. In some embodiments, a common base sequence is a base sequence that has a cleavage site within a characteristic sequence element in its stereorandom cleavage pattern. In some embodiments, a common base sequence is a base sequence that has a cleavage site in the vicinity of a characteristic sequence element in its stereorandom cleavage pattern. In some embodiments, a common base sequence is a base sequence that has a cleavage site in the vicinity of a mutation or SNP of a characteristic sequence element in its stereorandom cleavage pattern. In some embodiments, a common base sequence is a base sequence that has a cleavage site in the vicinity of a mutation in its stereorandom cleavage pattern. In some embodiments, a common base sequence is a base sequence that has a cleavage site in the vicinity of an SNP in its stereorandom cleavage pattern.

In some embodiments, a common base sequence is a base sequence that has a cleavage site in the vicinity of a mutation of a characteristic sequence element in its DNA and/or stereorandom cleavage pattern. In some embodiments, a common base sequence is a base sequence that has a cleavage site in the vicinity of a mutation in its DNA and/or stereorandom cleavage pattern. In some embodiments, a common base sequence is a base sequence that has a cleavage site in the vicinity of a mutation in its DNA cleavage pattern. In some embodiments, a cleavage site in the vicinity of a mutation is at a mutation, i.e., a cleavage site is at the internucleotidic linkage of a mutated nucleotide (e.g., if a mutation is at A in the target sequence of GGG<u>A</u>CGTCTT (SEQ ID NO: 9), the cleavage is between A and C). In some embodiments, a cleavage site in the vicinity is a cleavage site 0, 1, 2, 3, 4, 5, 6, 7, 8, 9, or 10 internucleotidic linkages away from a mutation, where 0 means cleavage at the mutation site (e.g., if a mutation is at A in the target sequence of GGG<u>A</u>CGTCTT (SEQ ID NO: 9), the cleavage is between A and C for 0 internucleotidic linkage away; a cleavage site 1 internucleotidic linkage away from the mutation is between G and A to the 5' from the mutation or between C and G to the 3' from the mutation). In some embodiments, a cleavage site in the vicinity is a cleavage site 0, 1, 2, 3, 4, or 5 internucleotidic linkages away from a mutation. In some embodiments, a cleavage site in the vicinity is a cleavage site 0, 1, 2, 3, 4, or 5 internucleotidic linkages away to the 5' from a mutation. In some embodiments, a cleavage site in the vicinity is a cleavage site 0, 1, 2, 3, 4, or 5 internucleotidic linkages away to the 3' from a mutation. In some embodiments, a cleavage site in the vicinity is a cleavage site 0, 1, 2, 3, 4, or 5 internucleotidic linkages away from a mutation. In some embodiments, a cleavage site in the vicinity is a cleavage site 0, 1, 2, 3, 4, or 5 internucleotidic linkages away to the 5' from a mutation. In some embodiments, a cleavage site in the vicinity is a cleavage site 0, 1, 2, 3, 4, or 5 internucleotidic linkages away to the 3' from a mutation. In some embodiments, a cleavage site in the vicinity is a cleavage site 0, 1, 2, 3, or 4 internucleotidic linkages away from a mutation. In some embodiments, a cleavage site in the vicinity is a cleavage site 0, 1, 2, 3, or 4 internucleotidic linkages away to the 5' from a mutation. In some embodiments, a cleavage site in the vicinity is a cleavage site 0, 1, 2, 3, or 4 internucleotidic linkages away to the 3' from a mutation. In some embodiments, a cleavage site in the vicinity is a cleavage site 0, 1, 2, or 3 internucleotidic linkages away from a mutation. In some embodiments, a cleavage site in the vicinity is a cleavage site 0, 1, 2, or 3 internucleotidic linkages away to the 5' from a mutation. In some embodiments, a cleavage site in the vicinity is a cleavage site 0, 1, 2, or 3 internucleotidic linkages away to the 3' from a mutation. In some embodiments, a cleavage site in the vicinity is a cleavage site 0, 1, or 2 internucleotidic linkages away from a mutation. In some embodiments, a cleavage site in the vicinity is a cleavage site 0, 1, or 2 internucleotidic linkages away to the 5' from a mutation. In some embodiments, a cleavage site in the vicinity is a cleavage site 0, 1, or 2 internucleotidic linkages away to the 3' from a mutation. In some embodiments, a cleavage site in the vicinity is a cleavage site 0 or 1 internucleotidic linkage away from a mutation. In some embodiments, a cleavage site in the vicinity is a cleavage site 0 or 1 internucleotidic linkage away to the 5' from a mutation. In some embodiments, a cleavage site in the vicinity is a cleavage site 0 or 1 internucleotidic linkage away to the 3' from a mutation. In some embodiments, a cleavage site in the vicinity is a cleavage site 0 internucleotidic linkage away from a mutation. In some embodiments, a cleavage site in the vicinity is a cleavage site one internucleotidic linkage away from a mutation. In some embodiments, a cleavage site in the vicinity is a cleavage site one internucleotidic linkage away to the 5' from a mutation. In some embodiments, a cleavage site in the vicinity is a cleavage site one internucleotidic linkage away to the 3' from a mutation. In some embodiments, a cleavage site in the vicinity is a cleavage site two internucleotidic linkages away from a mutation. In some embodiments, a cleavage site in the vicinity is a cleavage site two internucleotidic linkages away to the 5' from a mutation. In some embodiments, a cleavage site in the vicinity is a cleavage site two internucleotidic linkages away to the 3' from a mutation. In some embodiments, a cleavage site in the vicinity is a cleavage site three internucleotidic linkages away from a mutation. In some embodiments, a cleavage site in the vicinity is a cleavage site three internucleotidic linkages away to the 5' from a mutation. In some embodiments, a cleavage site in the vicinity is a cleavage site three internucleotidic linkages away to the 3' from a mutation. In some embodiments, a cleavage site in the vicinity is a cleavage site four internucleotidic linkages away from a mutation. In some embodiments, a cleavage site in the vicinity is a cleavage site four internucleotidic linkages away to the 5' from a mutation. In some embodiments, a cleavage site in the vicinity is a cleavage site four internucleotidic linkages away to the 3' from a mutation. In some embodiments, a cleavage site in the vicinity is a cleavage site five internucleotidic linkages away from a mutation. In some embodiments, a cleavage site in the vicinity is a cleavage site five internucleotidic linkages away to the 5' from a mutation. In some embodiments, a cleavage site in the vicinity is a cleavage site five internucleotidic linkages away to the 3' from a mutation.

In some embodiments, a common base sequence is a base sequence that has a cleavage site in the vicinity of an SNP of a characteristic sequence element in its DNA and/or stereorandom cleavage pattern. In some embodiments, a common base sequence is a base sequence that has a cleavage site in the vicinity of an SNP in its DNA and/or stereorandom cleavage pattern. In some embodiments, a common base sequence is a base sequence that has a cleavage site in the vicinity of an SNP in its DNA cleavage pattern. In some embodiments, a cleavage site in the vicinity of an SNP is at an SNP, i.e., a cleavage site is at the internucleotidic linkage of a nucleotide at an SNP (e.g., for the target of WV-905, G*G*C*A*C*A*A*G*G*G*C*A*C*A*G*A*C*T*T*C (SEQ ID NO: 10), which comprises rUrUrUrGrGrArArGrUrCrUrGrUrGrCrCrCrUrUrGrUrGrCrCrC (SEQ ID NO: 11) (rs362307 bolded), the cleavage is between the bolded rU and the underlined rG immediately after it). In some embodiments, a cleavage site in the vicinity is a cleavage site 0, 1, 2, 3, 4, 5, 6, 7, 8, 9, Or 10 internucleotidic linkages away from an SNP, where 0 means cleavage at an SNP (e.g., for the target of WV-905, G*G*C*A*C*A*A*G*G*G*C*A*C*A*G*A*C*T*T*C (SEQ ID NO: 10), which comprises rUrUrUrGrGrArArGrUrCrUrGrUrGrCrCrCrUrUrGrUrGrCrCrC (SEQ ID NO: 11) (rs362307 bolded), the cleavage is between the bolded rU and the underlined rG immediately after it for 0 internucleotidic linkage away; a cleavage site 1 internucleotidic linkage away from an SNP is between the rG and rU to the 5' from the SNP (underlined: rUrUrUrGrGrArArGrUrCrUrGrUrGrCrCrCrUrUrGrUrGrCrCrC (SEQ ID NO: 11)), or between rG and rC to the 3'-end of the SNP (underlined: rUrUrUrGrGrArArGrUrCrUrGrUrGrCrCrCrUrUrGrUrGrCrCrC (SEQ ID NO: 11))). In some embodiments, a cleavage site in the vicinity is a cleavage site 0, 1, 2, 3, 4, or 5 internucleotidic linkages away from an SNP. In some embodiments, a cleavage site in the vicinity is a cleavage site 0, 1, 2, 3, 4, or 5 internucleotidic linkages away to the 5' from an SNP. In some embodiments, a cleavage site in the vicinity is a cleavage site 0, 1, 2, 3, 4, or 5 internucleotidic linkages away to the 3' from an SNP. In some embodiments, a cleavage site in the vicinity is a cleavage site 0, 1, 2, 3, 4, or 5 internucleotidic linkages away from an SNP. In some embodiments, a cleavage site in the vicinity is a cleavage site 0, 1, 2, 3, 4, or 5 internucleotidic linkages away to the 5' from an SNP. In some embodiments, a cleavage site in the vicinity is a cleavage site 0, 1, 2, 3, 4, or 5 internucleotidic linkages away to the 3' from an SNP. In some embodiments, a cleavage site in the vicinity is a cleavage site 0, 1, 2, 3, or 4 internucleotidic linkages away from an SNP. In some embodiments, a cleavage site in the vicinity is a cleavage site 0, 1, 2, 3, or 4 internucleotidic linkages away to the 5' from an SNP. In some embodiments, a cleavage site in the vicinity is a cleavage site 0, 1, 2, 3, or 4 internucleotidic linkages away to the 3' from an SNP. In some embodiments, a cleavage site in the vicinity is a cleavage site 0, 1, 2, or 3 internucleotidic linkages away from an SNP. In some embodiments, a cleavage site in the vicinity is a cleavage site 0, 1, 2, or 3 internucleotidic linkages away to the 5' from an SNP. In some embodiments, a cleavage site in the vicinity is a cleavage site 0, 1, 2, or 3 internucleotidic linkages away to the 3' from an SNP. In some embodiments, a cleavage site in the vicinity is a cleavage site 0, 1, or 2 internucleotidic linkages away from an SNP. In some embodiments, a cleavage site in the vicinity is a cleavage site 0, 1, or 2 internucleotidic linkages away to the 5' from an SNP. In some embodiments, a cleavage site in the vicinity is a cleavage site 0, 1, or 2 internucleotidic linkages away to the 3' from an SNP. In some embodiments, a cleavage site in the vicinity is a cleavage site 0 or 1 internucleotidic linkage away from an SNP. In some embodiments, a cleavage site in the vicinity is a cleavage site 0 or 1 internucleotidic linkage away to the 5' from an SNP. In some embodiments, a cleavage site in the vicinity is a cleavage site 0 or 1 internucleotidic linkage away to the 3' from an SNP. In some embodiments, a cleavage site in the vicinity is a cleavage site 0 internucleotidic linkage away from an SNP. In some embodiments, a cleavage site in the vicinity is a cleavage site one internucleotidic linkage away from an SNP. In some embodiments, a cleavage site in the vicinity is a cleavage site one internucleotidic linkage away to the 5' from an SNP. In some embodiments, a cleavage site in the vicinity is a cleavage site one internucleotidic linkage away to the 3' from an SNP. In some embodiments, a cleavage site in the vicinity is a cleavage site two internucleotidic linkages away from an SNP. In some embodiments, a cleavage site in the vicinity is a cleavage site two internucleotidic linkages away to the 5' from an SNP. In some embodiments, a cleavage site in the vicinity is a cleavage site two internucleotidic linkages away to the 3' from an SNP. In some embodiments, a cleavage site in the vicinity is a cleavage site three internucleotidic linkages away from an SNP. In some embodiments, a cleavage site in the vicinity is a cleavage site three internucleotidic linkages away to the 5' from an SNP. In some embodiments, a cleavage site in the vicinity is a cleavage site three internucleotidic linkages away to the 3' from an SNP. In some embodiments, a cleavage site in the vicinity is a cleavage site four internucleotidic linkages away from an SNP. In some embodiments, a cleavage site in the vicinity is a cleavage site four internucleotidic linkages away to the 5' from an SNP. In some embodiments, a cleavage site in the vicinity is a cleavage site four internucleotidic linkages away to the 3' from an SNP. In some embodiments, a cleavage site in the vicinity is a cleavage site five internucleotidic linkages away from an SNP. In some embodiments, a cleavage site in the vicinity is a cleavage site five internucleotidic linkages away to the 5' from an SNP. In some embodiments, a cleavage site in the vicinity is a cleavage site five internucleotidic linkages away to the 3' from an SNP. For example, the stereorandom cleavage pattern of the WV-905 sequence has cleavage sites at the SNP (between CUGU and GCCC), two internucleotidic linkages away (between GUCU and GUGC, and between GUGC and CCUU), three internucleotidic linkages away (between UGCC and CUUG); four internucleotidic linkages away (between GCCC and UUGU, and AAGU and CUGU), and five internucleotidic linkages away (between CCCU and UGUG).

In some embodiments, a cleavage site within or in the vicinity of a characteristic sequence element, e.g., in the vicinity of a mutation, an SNP, etc., is a major cleavage site of a DNA and/or stereorandom cleavage pattern. In some embodiments, a cleavage site within or in the vicinity of a characteristic sequence element is a major cleavage site of a DNA cleavage pattern. In some embodiments, a cleavage site within or in the vicinity of a characteristic sequence element is a major cleavage site of a stereorandom cleavage pattern. In some embodiments, a cleavage site in the vicinity of a mutation is a major cleavage site of a DNA cleavage pattern. In some embodiments, a cleavage site in the vicinity of a mutation is a major cleavage site of a stereorandom cleavage pattern. In some embodiments, a cleavage site in the vicinity of an SNP is a major cleavage site of a DNA cleavage pattern. In some embodiments, a cleavage site in the vicinity of an SNP is a major cleavage site of a stereorandom cleavage pattern. In some embodiments, a major cleavage site is within a sequence complementary to a core region of a common sequence. In some embodiments, a major cleavage site is within a sequence 100% complementary to a core region of a common sequence.

In some embodiments, a major cleavage site is a site having the most, or the second, third, fourth or fifth most cleavage. In some embodiments, a major cleavage site is a site having the most, or the second, third, or fourth most cleavage. In some embodiments, a major cleavage site is a site having the most, or the second, or third most cleavage. In some embodiments, a major cleavage site is a site having the most or the second most cleavage. In some embodiments, a major cleavage site is a site having the most cleavage. In some embodiments, a major cleavage site is a site having the second most cleavage. In some embodiments, a major cleavage site is a site having the third most cleavage. In some embodiments, a major cleavage site is a site having the fourth most cleavage. In some embodiments, a major cleavage site is a site having the fifth most cleavage.

In some embodiments, a major cleavage site is a site wherein greater than 5%, 10%, 15%, 20%, 25%, 30%, 35%, 40%, 45%, 50%, 55%, 60%, 65%, 70%, 75%, 80%, 85%, 90%, 95%, 96%, 97%, 98% or 99% of cleavage occurs. In some embodiments, a major cleavage site is a site wherein greater than 5% of cleavage occurs. In some embodiments, a major cleavage site is a site wherein greater than 10% of cleavage occurs. In some embodiments, a major cleavage site is a site wherein greater than 15% of cleavage occurs. In some embodiments, a major cleavage site is a site wherein greater than 20% of cleavage occurs. In some embodiments, a major cleavage site is a site wherein greater than 25% of cleavage occurs. In some embodiments, a major cleavage site is a site wherein greater than 30% of cleavage occurs. In some embodiments, a major cleavage site is a site wherein greater than 35% of cleavage occurs. In some embodiments, a major cleavage site is a site wherein greater than 40% of cleavage occurs. In some embodiments, a major cleavage site is a site wherein greater than 45% of cleavage occurs. In some embodiments, a major cleavage site is a site wherein greater than 50% of cleavage occurs. In some embodiments, a major cleavage site is a site wherein greater than 55% of cleavage occurs. In some embodiments, a major cleavage site is a site wherein greater than 60% of cleavage occurs. In some embodiments, a major cleavage site is a site wherein greater than 65% of cleavage occurs. In some embodiments, a major cleavage site is a site wherein greater than 70% of cleavage occurs. In some embodiments, a major cleavage site is a site wherein greater than 75% of cleavage occurs. In some embodiments, a major cleavage site is a site wherein greater than 80% of cleavage occurs. In some embodiments, a major cleavage site is a site wherein greater than 85% of cleavage occurs. In some embodiments, a major cleavage site is a site wherein greater than 90% of cleavage occurs. In some embodiments, a major cleavage site is a site wherein greater than 91% of cleavage occurs. In some embodiments, a major cleavage site is a site wherein greater than 92% of cleavage occurs. In some embodiments, a major cleavage site is a site wherein greater than 93% of cleavage occurs. In some embodiments, a major cleavage site is a site wherein greater than 94% of cleavage occurs. In some embodiments, a major cleavage site is a site wherein greater than 95% of cleavage occurs. In some embodiments, a major cleavage site is a site wherein greater than 96% of cleavage occurs. In some embodiments, a major cleavage site is a site wherein greater than 97% of cleavage occurs. In some embodiments, a major cleavage site is a site wherein greater than 98% of cleavage occurs. In some embodiments, a major cleavage site is a site wherein greater than 99% of cleavage occurs. In some embodiments, a major cleavage site is a site wherein 100% of cleavage occurs.

In some embodiments, a major cleavage site is a site wherein greater than 5%, 10%, 15%, 20%, 25%, 30%, 35%, 40%, 45%, 50%, 55%, 60%, 65%, 70%, 75%, 80%, 85%, 90%, 95%, 96%, 97%, 98% or 99% of a target is cleaved. In some embodiments, a major cleavage site is a site wherein greater than 5% of a target is cleaved. In some embodiments, a major cleavage site is a site wherein greater than 10% of a target is cleaved. In some embodiments, a major cleavage site is a site wherein greater than 15% of a target is cleaved. In some embodiments, a major cleavage site is a site wherein greater than 20% of a target is cleaved. In some embodiments, a major cleavage site is a site wherein greater than 25% of a target is cleaved. In some embodiments, a major cleavage site is a site wherein greater than 30% of a target is cleaved. In some embodiments, a major cleavage site is a site wherein greater than 35% of a target is cleaved. In some embodiments, a major cleavage site is a site wherein greater than 40% of a target is cleaved. In some embodiments, a major cleavage site is a site wherein greater than 45% of a target is cleaved. In some embodiments, a major cleavage site is a site wherein greater than 50% of a target is cleaved. In some embodiments, a major cleavage site is a site wherein greater than 55% of a target is cleaved. In some embodiments, a major cleavage site is a site wherein greater than 60% of a target is cleaved. In some embodiments, a major cleavage site is a site wherein greater than 65% of a target is cleaved. In some embodiments, a major cleavage site is a site wherein greater than 70% of a target is cleaved. In some embodiments, a major cleavage site is a site wherein greater than 75% of a target is cleaved. In some embodiments, a major cleavage site is a site wherein greater than 80% of a target is cleaved. In some embodiments, a major cleavage site is a site wherein greater than 85% of a target is cleaved. In some embodiments, a major cleavage site is a site wherein greater than 90% of a target is cleaved. In some embodiments, a major cleavage site is a site wherein greater than 91% of a target is cleaved. In some embodiments, a major cleavage site is a site wherein greater than 92% of a target is cleaved. In some embodiments, a major cleavage site is a site wherein greater than 93% of a target is cleaved. In some embodiments, a major cleavage site is a site wherein greater than 94% of a target is cleaved. In some embodiments, a major cleavage site is a site wherein greater than 95% of a target is cleaved. In some embodiments, a major cleavage site is a site wherein greater than 96% of a target is cleaved. In some embodiments, a major cleavage site is a site wherein greater than 97% of a target is cleaved. In some embodiments, a major cleavage site is a site wherein greater than 98% of a target is cleaved. In some embodiments, a major cleavage site is a site wherein greater than 99% of a target is cleaved. In some embodiments, a major cleavage site is a site wherein 100% of a target is cleaved. In some embodiments, a cleavage pattern may not have a major cleavage site as no site reaches an absolute cleavage threshold level.

As a person having ordinary skill in the art understands, provided oligonucleotide compositions and methods have various uses as known by a person having ordinary skill in the art. Methods for assessing provided compositions, and properties and uses thereof, are also widely known and practiced by a person having ordinary skill in the art. Example properties, uses, and/or methods include but are not limited to those described in WO/2014/012081 and WO/2015/107425.

In some embodiments, a common base sequence comprises or is a sequence complementary to a nucleic acid sequence. In some embodiments, a common base sequence comprises or is a sequence 100% complementary to a nucleic acid sequence. In some embodiments, a common base sequence comprises or is a sequence complementary to a disease-causing nucleic acid sequence. In some embodiments, a common base sequence comprises or is a sequence 100% complementary to a disease-causing nucleic acid sequence. In some embodiments, a common base sequence comprises or is a sequence complementary to a characteristic sequence element of disease-causing nucleic acid sequence, which characteristic sequences differentiate a disease-causing nucleic acid sequence from a non-diseasing-causing nucleic acid sequence. In some embodiments, a common base sequence comprises or is a sequence 100% complementary to a characteristic sequence element of disease-causing nucleic acid sequence, which characteristic sequences differentiate a disease-causing nucleic acid sequence from a non-diseasing-causing nucleic acid sequence. In some embodiments, a common base sequence comprises or is a sequence complementary to a disease-associated nucleic acid sequence. In some embodiments, a common base sequence comprises or is a sequence 100% complementary to a disease-associated nucleic acid sequence. In some embodiments, a common base sequence comprises or is a sequence complementary to a characteristic sequence element of disease-associated nucleic acid sequence, which characteristic sequences differentiate a disease-associated nucleic acid sequence from a non-diseasing-associated nucleic acid sequence. In some embodiments, a common base sequence comprises or is a sequence 100% complementary to a characteristic sequence element of disease-associated nucleic acid sequence, which characteristic sequences differentiate a disease-associated nucleic acid sequence from a non-diseasing-associated nucleic acid sequence.

In some embodiments, a common base sequence comprises or is a sequence complementary to a gene. In some embodiments, a common base sequence comprises or is a sequence 100% complementary to a gene. In some embodiments, a common base sequence comprises or is a sequence complementary to a characteristic sequence element of a gene, which characteristic sequences differentiate the gene from a similar sequence sharing homology with the gene. In some embodiments, a common base sequence comprises or is a sequence 100% complementary to a characteristic sequence element of a gene, which characteristic sequences differentiate the gene from a similar sequence sharing homology with the gene. In some embodiments, a common base sequence comprises or is a sequence complementary to characteristic sequence element of a target gene, which characteristic sequences comprises a mutation that is not found in other copies of the gene, e.g., the wild-type copy of the gene, another mutant copy the gene, etc. In some embodiments, a common base sequence comprises or is a sequence 100% complementary to characteristic sequence element of a target gene, which characteristic sequences comprises a mutation that is not found in other copies of the gene, e.g. the wild-type copy of the gene, another mutant copy the gene, etc.

In some embodiments, a common base sequence comprises or is a sequence complementary to a sequence comprising an SNP. In some embodiments, a common base sequence comprises or is a sequence complementary to a sequence comprising an SNP, and the common base sequence is 100% complementary to the SNP that is associated with a disease. For example, in some embodiments, a common base sequence is 100% complementary to an SNP associated with a Huntington's disease-associated (or -causing) allele. In some embodiments, a common base sequence is that of WV-1092, which is 100% complementary to the disease-causing allele in many Huntington's disease patients at rs362307. In some embodiments, an SNP is rs362307. In some embodiments, an SNP is rs7685686. In some embodiments, an SNP is rs362268. In some embodiments, an SNP is rs362306. In some embodiments, other example SNP site may be any of the Huntingtin site disclosed in the present disclosure.

In some embodiments, a common base sequence comprises a sequence found in UCAAGGAAGAUGGCAUUUCU (SEQ ID NO: 54). In some embodiments, a common base sequence comprises a sequence found in UCAAGGAAGAUGGCAUUUCU (SEQ ID NO: 54), wherein the sequence found in UCAAGGAAGAUGG-CAUUUCU (SEQ ID NO: 54) comprises at least 15 nucleotides. In some embodiments, a common base sequence is UCAAGGAAGAUGGCAUUUCU (SEQ ID NO: 54). In some embodiments, one or more U is replaced by T, or vice versa, in a common base sequence.

In some embodiments, a common base sequence comprises a sequence found in GCCTCAGTCTGCTTCGCACC (SEQ ID NO: 12). In some embodiments, a common base sequence comprises a sequence found in GCCTCAGTCTGCTTCGCACC (SEQ ID NO: 12), wherein the sequence found in GCCTCAGTCTGCTTCGCACC (SEQ ID NO: 12) comprises at least 15 nucleotides. In some embodiments, a common base sequence is GCCTCAGTCTGCTTCGCACC (SEQ ID NO: 12).

In some embodiments, a common base sequence comprises a sequence found in GCCTCAGTCTGCTTCGCACC (SEQ ID NO: 13). In some embodiments, a common base sequence comprises a sequence found in GCCTCAGTCTGCTTCGCACC (SEQ ID NO: 13), wherein the sequence found in GCCTCAGTCTGCTTCGCACC (SEQ ID NO: 13) comprises at least 15 nucleotides. In some embodiments, a common base sequence is GCCTCAGTCTGCTTCGCACC (SEQ ID NO: 13). In some embodiments, a common base sequence is GGGCACAAGGGCACAGACTT (SEQ ID NO: 14). In some embodiments, a common base sequence is GCCTCAGTCTGCTTCGCACC (SEQ ID NO: 13). In some embodiments, a common base sequence is GCACAAGGGCACAGACTTCC (SEQ ID NO: 15). In some embodiments, a common base sequence is CACAAGGGCACAGACTTCCA (SEQ ID NO: 16). In some embodiments, a common base sequence is ACAAGGGCACAGACTTCCAA (SEQ ID NO: 17). In some embodiments, a common base sequence is CAAGGGCACAGACTTCCAAA (SEQ ID NO: 18). In some embodiments, a common base sequence comprises a sequence found in GCCTCAGTCTGCTTCGCACC (SEQ ID NO: 13). In some embodiments, a common base sequence comprises a sequence found in GCCTCAGTCTGCTTCGCACC (SEQ ID NO: 13), wherein the sequence found in GCCTCAGTCTGCTTCGCACC (SEQ ID NO: 13) comprises at least 15 nucleotides. In some embodiments, a common base sequence is GCCTCAGTCTGCTTCGCACC (SEQ ID NO: 13). In some embodiments, a common base sequence is GCCTCAGTCTGCTTCGCACC (SEQ ID NO: 13). In some embodiments, a common base sequence is AGCAGCTGCAACCTGGCAAC (SEQ ID NO: 19). In some embodiments, a common base sequence is GCAGCTGCAACCTGGCAACA (SEQ ID NO: 20). In some embodiments, a common base sequence is CAGCTGCAACCTGGCAACAA (SEQ ID NO: 21). In some embodiments, a common base sequence is AGCTGCAACCTGGCAACAAC (SEQ ID NO: 22). In some embodiments, a common base sequence is GCTGCAACCTGGCAACAACC (SEQ ID NO: 23). In some embodiments, a common base sequence comprises a sequence found in GGGCCAACAGCCAGCCTGCA (SEQ ID NO: 24). In some embodiments, a common base sequence comprises a sequence found in GGGC-CAACAGCCAGCCTGCA (SEQ ID NO: 24), wherein the sequence found in GGGCCAACAGCCAGCCTGCA (SEQ ID NO: 24) comprises at least 15 nucleotides. In some embodiments, a common base sequence is GGGC-CAACAGCCAGCCTGCA (SEQ ID NO: 24). In some embodiments, a common base sequence is GGGC-CAACAGCCAGCCTGCA (SEQ ID NO: 24). In some embodiments, a common base sequence is GGC-CAACAGCCAGCCTGCAG (SEQ ID NO: 25). In some embodiments, a common base sequence is GCCAACAGCCAGCCTGCAGG (SEQ ID NO: 26). In some embodiments, a common base sequence is CCAACAGCCAGCCTGCAGGA (SEQ ID NO: 27). In some embodiments, a common base sequence is CAACAGCCAGCCTGCAGGAG (SEQ ID NO: 28). In some embodiments, a common base sequence is AACAGCCAGCCTGCAGGAGG (SEQ ID NO: 29). In some embodiments, a common base sequence comprises a sequence found in ATTAATAAATTGTCATCACC (SEQ ID NO: 30). In some embodiments, a common base sequence comprises a sequence found in ATTAATAAATTGTCAT-CACC (SEQ ID NO: 30), wherein the sequence found in ATTAATAAATTGTCATCACC (SEQ ID NO: 30) comprises at least 15 nucleotides. In some embodiments, a common base sequence is ATTAATAAATTGTCATCACC (SEQ ID NO: 30). In some embodiments, a common base sequence is ATTAATAAATTGTCATCACC (SEQ ID NO: 30). In some embodiments, a common base sequence is UCAAGGAAGAUGGCAUUUCU (SEQ ID NO: 54). In some embodiments, a common base sequence comprises UCAAGGAAGAUGGCA (SEQ ID NO: 1212). In some embodiments, a common base sequence comprises CAAGGAAGAUGGCAU (SEQ ID NO: 1213). In some embodiments, a common base sequence comprises AAGGAAGAUGGCAUU (SEQ ID NO: 1214). In some embodiments, a common base sequence comprises AGGAAGAUGGCAUUU (SEQ ID NO: 1215). In some embodiments, a common base sequence comprises GGAAGAUGGCAUUUC (SEQ ID NO: 1216). In some embodiments, a common base sequence comprises GAAGAUGGCAUUUCU (SEQ ID NO: 1217). In some embodiments, a common base sequence comprises CAAGGAAGAUGGCAUUUCU (SEQ ID NO: 1125). In some embodiments, a common base sequence comprises UCAAGGAAGAUGGCAUUUC (SEQ ID NO: 1123). In some embodiments, a common base sequence comprises CAAGGAAGAUGGCAUUUC (SEQ ID NO: 1218). In some embodiments, a common base sequence comprises AAGGAAGAUGGCAUUUCU (SEQ ID NO: 1219). In some embodiments, a common base sequence comprises UCAAGGAAGAUGGCAUUU (SEQ ID NO: 1124). In some embodiments, a common base sequence comprises AAGGAAGAUGGCAUUU (SEQ ID NO: 1220). In some embodiments, a common base sequence comprises CAAGGAAGAUGGCAUUU (SEQ ID NO: 1221). In some embodiments, a common base sequence comprises AAGGAAGAUGGCAUUUC (SEQ ID NO: 1222). In some embodiments, a common base sequence is UCAAGGAAGAUGGCA (SEQ ID NO: 1212). In some embodiments, a common base sequence is AAGGAAGAUGGCAUU (SEQ ID NO: 1214). In some embodiments, a common base sequence is CAAGGAAGAUGGCAU (SEQ ID NO: 1213). In some embodiments, a common base sequence is AGGAAGAUGGCAUUU (SEQ ID NO: 1215). In some embodiments, a common base sequence is GGAAGAUGG-CAUUUC (SEQ ID NO: 1216). In some embodiments, a common base sequence is GAAGAUGGCAUUUCU (SEQ ID NO: 1217). In some embodiments, a common base sequence is CAAGGAAGAUGGCAUUUC (SEQ ID NO: 1218). In some embodiments, a common base sequence is AAGGAAGAUGGCAUUUCU (SEQ ID NO: 1219). In some embodiments, a common base sequence is AAGGAAGAUGGCAUUU (SEQ ID NO: 1220). In some embodiments, a common base sequence is CAAGGAAGAUGGCAUUU (SEQ ID NO: 1221). In some embodiments, a common base sequence is AAGGAAGAUGGCAUUUC (SEQ ID NO: 1222). In some embodiments, a common base sequence comprises AGGAAGAUGGCAUU (SEQ ID NO: 1223). In some embodiments, a common base sequence comprises UCAAGGAAGAUGGC (SEQ ID NO: 1224). In some embodiments, a common base sequence comprises CAAGGAAGAUGGCA (SEQ ID NO: 1225). In some embodiments, a common base sequence comprises AAGGAAGAUGGCAU (SEQ ID NO: 1226). In some embodiments, a common base sequence comprises GGAAGAUGGCAUUU (SEQ ID NO: 1227). In some embodiments, a common base sequence comprises GAAGAUGGCAUUUC (SEQ ID NO: 1228). In some embodiments, a common base sequence comprises AAGAUGGCAUUUCU (SEQ ID NO: 1229). In some embodiments, a common base sequence is AGGAAGAUGGCAUU (SEQ ID NO: 1223). In some embodiments, a common base sequence is UCAAGGAAGAUGGC (SEQ ID NO: 1224). In some embodiments, a common base sequence is CAAGGAAGAUGGCA (SEQ ID NO: 1225). In some embodiments, a common base sequence is AAGGAAGAUGGCAU (SEQ ID NO: 1226). In some embodiments, a common base sequence is GGAAGAUGGCAUUU (SEQ ID NO: 1227). In some embodiments, a common base sequence is GAAGAUGGCAUUUC (SEQ ID NO: 1228). In some embodiments, a common base sequence is AAGAUGGCAUUUCU (SEQ ID NO: 1229).

In some embodiments, a chiral internucleotidic linkage has the structure of formula I. In some embodiments, a chiral internucleotidic linkage is phosphorothioate. In some embodiments, each chiral internucleotidic linkage in a single oligonucleotide of a provided composition independently has the structure of formula I. In some embodiments, each chiral internucleotidic linkage in a single oligonucleotide of a provided composition is a phosphorothioate.

In some embodiments, oligonucleotides of the present disclosure comprise one or more modified sugar moieties. In some embodiments, oligonucleotides of the present disclosure comprise one or more modified base moieties. As known by a person of ordinary skill in the art and described in the disclosure, various modifications can be introduced to a sugar and/or moiety. For example, in some embodiments, a modification is a modification described in U.S. Pat. No. 9,006,198, WO2014/012081 and WO/2015/107425, the sugar and base modifications of each of which are incorporated herein by reference.

In some embodiments, a sugar modification is a 2'-modification. Commonly used 2'-modifications include but are not limited to 2'-$OR^1$, wherein $R^1$ is not hydrogen. In some embodiments, a modification is 2'-OR, wherein R is optionally substituted aliphatic. In some embodiments, a modification is 2'-OMe. In some embodiments, a modification is 2'-O-MOE. In some embodiments, the present disclosure demonstrates that inclusion and/or location of particular chirally pure internucleotidic linkages can provide stability improvements comparable to or better than those achieved through use of modified backbone linkages, bases, and/or sugars. In some embodiments, a provided single oligonucleotide of a provided composition has no modifications on the sugars. In some embodiments, a provided single oligonucleotide of a provided composition has no modifications on 2'-positions of the sugars (i.e., the two groups at the 2'-position are either —H/—H or —H/—OH). In some embodiments, a provided single oligonucleotide of a provided composition does not have any 2'-MOE modifications.

In some embodiments, a 2'-modification is —O-L- or -L- which connects the 2'-carbon of a sugar moiety to another carbon of a sugar moiety. In some embodiments, a 2'-modification is —O-L- or -L- which connects the 2'-carbon of a sugar moiety to the 4'-carbon of a sugar moiety. In some embodiments, a 2'-modification is S-cEt. In some embodiments, a modified sugar moiety is an LNA moiety.

In some embodiments, a 2'-modification is —F. In some embodiments, a 2'-modification is FANA. In some embodiments, a 2'-modification is FRNA.

In some embodiments, a sugar modification is a 5'-modification, e.g., R-5'-Me, S-5'-Me, etc.

In some embodiments, a sugar modification changes the size of the sugar ring. In some embodiments, a sugar modification is the sugar moiety in FHNA.

In some embodiments, a sugar modification replaces a sugar moiety with another cyclic or acyclic moiety. Examples of such moieties are widely known in the art, including but not limited to those used in morpholio (optionally with its phosphorodiamidate linkage), glycol nucleic acids, etc.

In some embodiments, a single oligonucleotide in a provided composition has at least about 25% of its internucleotidic linkages in Sp configuration. In some embodiments, a single oligonucleotide in a provided composition has at least about 30% of its internucleotidic linkages in Sp configuration. In some embodiments, a single oligonucleotide in a provided composition has at least about 35% of its internucleotidic linkages in Sp configuration. In some embodiments, a single oligonucleotide in a provided composition has at least about 40% of its internucleotidic linkages in Sp configuration. In some embodiments, a single oligonucleotide in a provided composition has at least about 45% of its internucleotidic linkages in Sp configuration. In some embodiments, a single oligonucleotide in a provided composition has at least about 50% of its internucleotidic linkages in Sp configuration. In some embodiments, a single oligonucleotide in a provided composition has at least about 55% of its internucleotidic linkages in Sp configuration. In some embodiments, a single oligonucleotide in a provided composition has at least about 60% of its internucleotidic linkages in Sp configuration. In some embodiments, a single oligonucleotide in a provided composition has at least about 65% of its internucleotidic linkages in Sp configuration. In some embodiments, a single oligonucleotide in a provided composition has at least about 70% of its internucleotidic linkages in Sp configuration. In some embodiments, a single oligonucleotide in a provided composition has at least about 75% of its internucleotidic linkages in Sp configuration. In some embodiments, a single oligonucleotide in a provided composition has at least about 80% of its internucleotidic linkages in Sp configuration. In some embodiments, a single oligonucleotide in a provided composition has at least about 85% of its internucleotidic linkages in Sp configuration. In some embodiments, a single oligonucleotide in a provided composition has at least about 90% of its internucleotidic linkages in Sp configuration.

In some embodiments, oligonucleotides in a provided composition is not an oligonucleotide selected from: $T_kT_k{}^mC_kAGT{}^mCATGA{}^mCT_kT{}^mC_k{}^mC_k$ (SEQ ID NO: 31), wherein each nucleoside followed by a subscript 'k' indicates a (S)-cEt modification, R is Rp phosphorothioate linkage, S is Sp phosphorothioate linkage, each $^m$C is a 5-methyl cytosine modified nucleoside, and all internucleoside linkages are phosphorothioates (PS) with stereochemistry patterns selected from RSSSRSRRRS, RSSSSSSSSS, SRRSRSSSSR, SRSRSSRSSR, RRRSSSRSSS, RRRSRSSRSR, RRSSSRSRSR, SRSSSRSSSS, SSRRSSRSRS, SSSSSSRRSS, RRRSSRRRSR, RRRRSSSSRS, SRRSRRRRRR, RSSRSSRRRR, RSRRSRRSRR, RRSRSSRSRS, SSRRRRRSRR, RSRRSRSSSR, RRSSRSRRRR, RRSRSRRSSS, RRSRSSSRRR, RSRRRRSRSR, SSRSSSRRRS, RSSRSRSRSR, RSRSRSSRSS, RRRRSSRRSRS, SRRSSRRSRS, RRRRSRSRRR, SSSSRRRRSR, RRRRRRRRRR and SSSSSSSSSS.

In some embodiments, a single oligonucleotide in a provided composition is not an oligonucleotide selected from: $T_kT_k{}^{m}C_kAGT{}^{m}CATGA{}^{m}CTT_k{}^{m}C_k{}^{m}C_k$ (SEQ ID NO: 32), wherein each nucleoside followed by a subscript 'k' indicates a (S)-cEt modification, R is Rp phosphorothioate linkage, S is Sp phosphorothioate linkage, each $^{m}C$ is a 5-methyl cytosine modified nucleoside and all core internucleoside linkages are phosphorothioates (PS) with stereochemistry patterns selected from: RSSSRSRRRS, RSSSSSSSSS, SRRSRSSSSR, SRSRSSRSSR, RRRSSSRSSS, RRRSRSSRSR, RRSSSRSRSR, SRSSSRSSSS, SSRRSSRSRS, SSSSSSRRSS, RRRSSRRRSR, RRRRSSSSRS, SRRSRRRRRR, RSSRSSRRRR, RSRRSRRSRR, RRSRSSRSRS, SSRRRRRSRR, RSRRSRSSSR, RRSSRSRRRR, RRSRSRRSSS, RRSRSSSRRR, RSRRRRSRSR, SSRSSSRRRS, RSSRSRSRSR, RSRSRSSRSS, RRRSSRRSRS, SRRSSRRSRS, RRRRSRSRRR, SSSSRRRRSR, RRRRRRRRRR and SSSSSSSSSS.

Chirally Controlled Oligonucleotides and Chirally Controlled Oligonucleotide Compositions The present disclosure provides chirally controlled oligonucleotides, and chirally controlled oligonucleotide compositions which are of high crude purity and of high diastereomeric purity. In some embodiments, the present disclosure provides chirally controlled oligonucleotides, and chirally controlled oligonucleotide compositions which are of high crude purity. In some embodiments, the present disclosure provides chirally controlled oligonucleotides, and chirally controlled oligonucleotide compositions which are of high diastereomeric purity.

In some embodiments, a chirally controlled oligonucleotide composition is a substantially pure preparation of an oligonucleotide type in that oligonucleotides in the composition that are not of the oligonucleotide type are impurities form the preparation process of said oligonucleotide type, in some case, after certain purification procedures.

In some embodiments, the present disclosure provides oligonucleotides comprising one or more diastereomerically pure internucleotidic linkages with respect to the chiral linkage phosphorus. In some embodiments, the present disclosure provides oligonucleotides comprising one or more diastereomerically pure internucleotidic linkages having the structure of formula I. In some embodiments, the present disclosure provides oligonucleotides comprising one or more diastereomerically pure internucleotidic linkages with respect to the chiral linkage phosphorus, and one or more phosphate diester linkages. In some embodiments, the present disclosure provides oligonucleotides comprising one or more diastereomerically pure internucleotidic linkages having the structure of formula I, and one or more phosphate diester linkages. In some embodiments, the present disclosure provides oligonucleotides comprising one or more diastereomerically pure internucleotidic linkages having the structure of formula I-c, and one or more phosphate diester linkages. In some embodiments, such oligonucleotides are prepared by using stereoselective oligonucleotide synthesis, as described in this application, to form pre-designed diastereomerically pure internucleotidic linkages with respect to the chiral linkage phosphorus. For instance, in one example oligonucleotide of (Rp/Sp, Rp/Sp, Rp/Sp, Rp, Rp, Sp, Sp, Sp, Sp, Sp Sp, Sp, Sp, Sp, Rp, Rp, Rp, Rp, Rp)-d [GsCsCsTsCsAsGsTsCsTsGsCsTsTsCsGs1Cs1As1CsC] (SEQ ID NO: 33), the first three internucleotidic linkages are constructed using traditional oligonucleotide synthesis method, and the diastereomerically pure internucleotidic linkages are constructed with stereochemical control as described in this application. Example internucleotidic linkages, including those having structures of formula I, are further described below.

In some embodiments, the present disclosure provides a chirally controlled oligonucleotide, wherein at least two of the individual internucleotidic linkages within the oligonucleotide have different stereochemistry and/or different P-modifications relative to one another. In certain embodiments, the present disclosure provides a chirally controlled oligonucleotide, wherein at least two individual internucleotidic linkages within the oligonucleotide have different P-modifications relative to one another. In certain embodiments, the present disclosure provides a chirally controlled oligonucleotide, wherein at least two of the individual internucleotidic linkages within the oligonucleotide have different P-modifications relative to one another, and wherein the chirally controlled oligonucleotide comprises at least one phosphate diester internucleotidic linkage. In certain embodiments, the present disclosure provides a chirally controlled oligonucleotide, wherein at least two of the individual internucleotidic linkages within the oligonucleotide have different P-modifications relative to one another, and wherein the chirally controlled oligonucleotide comprises at least one phosphate diester internucleotidic linkage and at least one phosphorothioate diester internucleotidic linkage. In certain embodiments, the present disclosure provides a chirally controlled oligonucleotide, wherein at least two of the individual internucleotidic linkages within the oligonucleotide have different P-modifications relative to one another, and wherein the chirally controlled oligonucleotide comprises at least one phosphorothioate triester internucleotidic linkage. In certain embodiments, the present disclosure provides a chirally controlled oligonucleotide, wherein at least two of the individual internucleotidic linkages within the oligonucleotide have different P-modifications relative to one another, and wherein the chirally controlled oligonucleotide comprises at least one phosphate diester internucleotidic linkage and at least one phosphorothioate triester internucleotidic linkage.

In certain embodiments, a modified internucleotidic linkages has the structure of formula I:

(I)

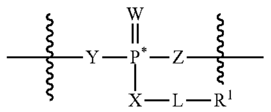

wherein each variable is as defined and described below. In some embodiments, a linkage of formula I is chiral. In some embodiments, the present disclosure provides a chirally controlled oligonucleotide comprising one or more modified internucleotidic linkages of formula I. In some embodiments, the present disclosure provides a chirally controlled oligonucleotide comprising one or more modified internucleotidic linkages of formula I, and wherein individual internucleotidic linkages of formula I within the oligonucleotide have different P-modifications relative to one another. In some embodiments, the present disclosure provides a chirally controlled oligonucleotide comprising one or more modified internucleotidic linkages of formula I, and wherein individual internucleotidic linkages of formula I within the oligonucleotide have different —X-L-$R^1$ relative to one another. In some embodiments, the present disclosure provides a chirally controlled oligonucleotide comprising one or more modified internucleotidic linkages of formula I, and wherein individual internucleotidic linkages of formula I within the oligonucleotide have different X relative to one another. In some embodiments, the present disclosure provides a chirally controlled oligonucleotide comprising one or more modified internucleotidic linkages of formula I, and wherein individual internucleotidic linkages of formula I within the oligonucleotide have different -L-$R^1$ relative to one another. In some embodiments, a chirally controlled oligonucleotide is an oligonucleotide in a provided composition that is of the particular oligonucleotide type. In some embodiments, a chirally controlled oligonucleotide is an oligonucleotide in a provided composition that has the common base sequence and length, the common pattern of backbone linkages, and the common pattern of backbone chiral centers.

In some embodiments, a chirally controlled oligonucleotide is an oligonucleotide in a chirally controlled composition that is of the particular oligonucleotide type, and the chirally controlled oligonucleotide is of the type. In some embodiments, a chirally controlled oligonucleotide is an oligonucleotide in a provided composition that comprises a predetermined level of a plurality of oligonucleotides that share a common base sequence, a common pattern of backbone linkages, and a common pattern of backbone chiral centers, and the chirally controlled oligonucleotide shares the common base sequence, the common pattern of backbone linkages, and the common pattern of backbone chiral centers.

In some embodiments, the present disclosure provides a chirally controlled oligonucleotide, wherein at least two of the individual internucleotidic linkages within the oligonucleotide have different stereochemistry and/or different P-modifications relative to one another. In some embodiments, the present disclosure provides a chirally controlled oligonucleotide, wherein at least two of the individual internucleotidic linkages within the oligonucleotide have different stereochemistry relative to one another, and wherein at least a portion of the structure of the chirally controlled oligonucleotide is characterized by a repeating pattern of alternating stereochemistry.

In some embodiments, the present disclosure provides a chirally controlled oligonucleotide, wherein at least two of the individual internucleotidic linkages within the oligonucleotide have different P-modifications relative to one another, in that they have different X atoms in their —$XLR^1$ moieties, and/or in that they have different L groups in their —$XLR^1$ moieties, and/or that they have different $R^1$ atoms in their —$XLR^1$ moieties.

In some embodiments, the present disclosure provides a chirally controlled oligonucleotide, wherein at least two of the individual internucleotidic linkages within the oligonucleotide have different stereochemistry and/or different P-modifications relative to one another and the oligonucleotide has a structure represented by the following formula:

$$[S^Bn1R^Bn2S^Bn3R^Bn4 \ldots S^BnxR^Bny]$$

wherein:

each $R^B$ independently represents a block of nucleotide units having the R configuration at the linkage phosphorus;

each $S^B$ independently represents a block of nucleotide units having the S configuration at the linkage phosphorus;

each of n1-ny is zero or an integer, with the requirement that at least one odd n and at least one even n must be non-zero so that the oligonucleotide includes at least two individual internucleotidic linkages with different stereochemistry relative to one another; and wherein the sum of n1-ny is between 2 and 200, and in some embodiments is between a lower limit selected from the group consisting of 2, 3, 4, 5, 6, 7, 8, 9, 10, 11, 12, 13, 14, 15, 16, 17, 18, 19, 20, 21, 22, 23, 24, 25 or more and an upper limit selected from the group consisting of 5, 10, 15, 20, 25, 30, 35, 40, 45, 50, 55, 60, 65, 70, 75, 80, 85, 90, 95, 100, 110, 120, 130, 140, 150, 160, 170, 180, 190, and 200, the upper limit being larger than the lower limit.

In some such embodiments, each n has the same value; in some embodiments, each even n has the same value as each other even n; in some embodiments, each odd n has the same value each other odd n; in some embodiments, at least two even ns have different values from one another; in some embodiments, at least two odd ns have different values from one another.

In some embodiments, at least two adjacent ns are equal to one another, so that a provided oligonucleotide includes adjacent blocks of S stereochemistry linkages and R stereochemistry linkages of equal lengths. In some embodiments, provided oligonucleotides include repeating blocks of S and R stereochemistry linkages of equal lengths. In some embodiments, provided oligonucleotides include repeating blocks of S and R stereochemistry linkages, where at least two such blocks are of different lengths from one another; in some such embodiments each S stereochemistry block is of the same length, and is of a different length from each R stereochemistry length, which may optionally be of the same length as one another.

In some embodiments, at least two skip-adjacent ns are equal to one another, so that a provided oligonucleotide includes at least two blocks of linkages of a first stereochemistry that are equal in length to one another and are separated by a block of linkages of the other stereochemistry, which separating block may be of the same length or a different length from the blocks of first stereochemistry.

In some embodiments, ns associated with linkage blocks at the ends of a provided oligonucleotide are of the same length. In some embodiments, provided oligonucleotides have terminal blocks of the same linkage stereochemistry. In some such embodiments, the terminal blocks are separated from one another by a middle block of the other linkage stereochemistry.

In some embodiments, a provided oligonucleotide of formula $[S^Bn1R^Bn2S^Bn3R^Bn4 \ldots S^BnxR^Bny]$ is a stereoblockmer. In some embodiments, a provided oligonucleotide of formula $[S^Bn1R^Bn2S^Bn3R^Bn4 \ldots S^BnxR^Bny]$ is a stereoskipmer. In some embodiments, a provided oligonucleotide of formula $[S^Bn1R^Bn2S^Bn3R^Bn4 \ldots S^BnxR^Bny]$ is a stereoaltmer. In some embodiments, a provided oligonucleotide of formula [$S^Bn1R^Bn2S^Bn3R^Bn4 \ldots S^BnxR^Bny$] is a gapmer.

In some embodiments, a provided oligonucleotide of formula [$S^Bn1R^Bn2S^Bn3R^Bn4 \ldots S^BnxR^Bny$] is of any of the above described patterns and further comprises patterns of P-modifications. For instance, in some embodiments, a provided oligonucleotide of formula [$S^Bn1R^Bn2S^Bn3R^Bn4 \ldots S^BnxR^Bny$] and is a stereoskipmer and P-modification skipmer. In some embodiments, a provided oligonucleotide of formula [$S^Bn1R^Bn2S^Bn3R^Bn4 \ldots S^BnxR^Bny$] and is a stereoblockmer and P-modification altmer. In some embodiments, a provided oligonucleotide of formula [$S^Bn1R^Bn2S^Bn3R^Bn4 \ldots S^BnxR^Bny$] and is a stereoaltmer and P-modification blockmer.

In some embodiments, a provided oligonucleotide of formula [$S^Bn1R^Bn2S^Bn3R^Bn4 \ldots S^BnxR^Bny$] is a chirally controlled oligonucleotide comprising one or more modified internucleotidic linkages independently having the structure of formula I.

(I)

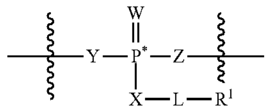

wherein:

P* is an asymmetric phosphorus atom and is either Rp or Sp;

W is O, S or Se;

each of X, Y and Z is independently —O—, —S—, —N(-L-$R^1$)—, or L;

L is a covalent bond or an optionally substituted, linear or branched $C_1$-$C_{10}$ alkylene, wherein one or more methylene units of L are optionally and independently replaced by an optionally substituted group selected from $C_1$-$C_6$ alkylene, $C_1$-$C_6$ alkenylene, —C≡C—, a $C_1$-$C_6$ heteroaliphatic moiety, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$— —SC(O)—, —C(O)S—, —OC(O)—, and —C(O)O—;

$R^1$ is halogen, R, or an optionally substituted $C_1$-$C_{50}$ aliphatic wherein one or more methylene units are optionally and independently replaced by an optionally substituted group selected from $C_1$-$C_6$ alkylene, $C_1$-$C_6$ alkenylene, —C≡C—, a $C_1$-$C_6$ heteroaliphatic moiety, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$— —SC(O)—, —C(O)S—, —OC(O)—, and —C(O)O—;

each R' is independently —R, —C(O)R, —$CO_2$R, or —$SO_2$R, or:

two R' are taken together with their intervening atoms to form an optionally substituted aryl, carbocyclic, heterocyclic, or heteroaryl ring;

-Cy- is an optionally substituted bivalent ring selected from phenylene, carbocyclylene, arylene, heteroarylene, and heterocyclylene;

each R is independently hydrogen, or an optionally substituted group selected from $C_1$-$C_6$ aliphatic, carbocyclyl, aryl, heteroaryl, and heterocyclyl; and each

independently represents a connection to a nucleoside.

In some embodiments, L is a covalent bond or an optionally substituted, linear or branched $C_1$-$C_{10}$ alkylene, wherein one or more methylene units of L are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—;

$R^1$ is halogen, R, or an optionally substituted $C_1$-$C_{50}$ aliphatic wherein one or more methylene units are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—;

each R' is independently —R, —C(O)R, —$CO_2$R, or —$SO_2$R, or:

two R' on the same nitrogen are taken together with their intervening atoms to form an optionally substituted heterocyclic or heteroaryl ring, or two R' on the same carbon are taken together with their intervening atoms to form an optionally substituted aryl, carbocyclic, heterocyclic, or heteroaryl ring;

-Cy- is an optionally substituted bivalent ring selected from phenylene, carbocyclylene, arylene, heteroarylene, or heterocyclylene;

each R is independently hydrogen, or an optionally substituted group selected from $C_1$-$C_6$ aliphatic, phenyl, carbocyclyl, aryl, heteroaryl, or heterocyclyl; and each

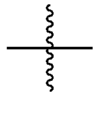

independently represents a connection to a nucleoside.

In some embodiments, a chirally controlled oligonucleotide comprises one or more modified internucleotidic phosphorus linkages. In some embodiments, a chirally controlled oligonucleotide comprises, e.g., a phosphorothioate or a phosphorothioate triester linkage. In some embodiments, a chirally controlled oligonucleotide comprises a phosphorothioate triester linkage. In some embodiments, a chirally controlled oligonucleotide comprises at least two phosphorothioate triester linkages. In some embodiments, a chirally controlled oligonucleotide comprises at least three phosphorothioate triester linkages. In some embodiments, a chirally controlled oligonucleotide comprises at least four phosphorothioate triester linkages. In some embodiments, a chirally controlled oligonucleotide comprises at least five phosphorothioate triester linkages. Examples of such modified internucleotidic phosphorus linkages are described further herein.

In some embodiments, a chirally controlled oligonucleotide comprises different internucleotidic phosphorus linkages. In some embodiments, a chirally controlled oligonucleotide comprises at least one phosphate diester internucleotidic linkage and at least one modified internucleotidic linkage. In some embodiments, a chirally controlled oligonucleotide comprises at least one phosphate diester internucleotidic linkage and at least one phosphorothioate triester linkage. In some embodiments, a chirally controlled oligonucleotide comprises at least one phosphate diester internucleotidic linkage and at least two phosphorothioate triester linkages. In some embodiments, a chirally controlled oligonucleotide comprises at least one phosphate diester internucleotidic linkage and at least three phosphorothioate triester linkages. In some embodiments, a chirally controlled oligonucleotide comprises at least one phosphate diester internucleotidic linkage and at least four phosphorothioate triester linkages. In some embodiments, a chirally controlled oligonucleotide comprises at least one phosphate diester internucleotidic linkage and at least five phosphorothioate triester linkages. Examples of such modified internucleotidic phosphorus linkages are described further herein.

In some embodiments, a phosphorothioate triester linkage comprises a chiral auxiliary, which, for example, is used to control the stereoselectivity of a reaction. In some embodiments, a phosphorothioate triester linkage does not comprise a chiral auxiliary. In some embodiments, a phosphorothioate triester linkage is intentionally maintained until and/or during the administration to a subject.

In some embodiments, a chirally controlled oligonucleotide is linked to a solid support. In some embodiments, a chirally controlled oligonucleotide is cleaved from a solid support.

In some embodiments, a chirally controlled oligonucleotide comprises at least one phosphate diester internucleotidic linkage and at least two consecutive modified internucleotidic linkages. In some embodiments, a chirally controlled oligonucleotide comprises at least one phosphate diester internucleotidic linkage and at least two consecutive phosphorothioate triester internucleotidic linkages.

In some embodiments, a chirally controlled oligonucleotide is a blockmer. In some embodiments, a chirally controlled oligonucleotide is a stereoblockmer. In some embodiments, a chirally controlled oligonucleotide is a P-modification blockmer. In some embodiments, a chirally controlled oligonucleotide is a linkage blockmer.

In some embodiments, a chirally controlled oligonucleotide is an altmer. In some embodiments, a chirally controlled oligonucleotide is a stereoaltmer. In some embodiments, a chirally controlled oligonucleotide is a P-modification altmer. In some embodiments, a chirally controlled oligonucleotide is a linkage altmer.

In some embodiments, a chirally controlled oligonucleotide is a unimer. In some embodiments, a chirally controlled oligonucleotide is a stereounimer. In some embodiments, a chirally controlled oligonucleotide is a P-modification unimer. In some embodiments, a chirally controlled oligonucleotide is a linkage unimer.

In some embodiments, a chirally controlled oligonucleotide is a gapmer.

In some embodiments, a chirally controlled oligonucleotide is a skipmer.

In some embodiments, the present disclosure provides oligonucleotides comprising one or more modified internucleotidic linkages independently having the structure of formula I:

(I)

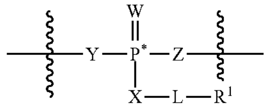

wherein:

P* is an asymmetric phosphorus atom and is either Rp or Sp;

W is O, S or Se;

each of X, Y and Z is independently —O—, —S—, —N(-L-$R^1$)—, or L;

L is a covalent bond or an optionally substituted, linear or branched $C_1$-$C_{10}$ alkylene, wherein one or more methylene units of L are optionally and independently replaced by an optionally substituted group selected from $C_1$-$C_6$ alkylene, $C_1$-$C_6$ alkenylene, —C≡C—, a $C_1$-$C_6$ heteroaliphatic moiety, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$— —SC(O)—, —C(O)S—, —OC(O)—, and —C(O)O—;

$R^1$ is halogen, R, or an optionally substituted $C_1$-$C_{50}$ aliphatic wherein one or more methylene units are optionally and independently replaced by an optionally substituted group selected from $C_1$-$C_6$ alkylene, $C_1$-$C_6$ alkenylene, —C≡C—, a $C_1$-$C_6$ heteroaliphatic moiety, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$— —SC(O)—, —C(O)S—, —OC(O)—, and —C(O)O— each R' is independently —R, —C(O)R, —$CO_2$R, or —$SO_2$R, or:

two R' are taken together with their intervening atoms to form an optionally substituted aryl, carbocyclic, heterocyclic, or heteroaryl ring;

-Cy- is an optionally substituted bivalent ring selected from phenylene, carbocyclylene, arylene, heteroarylene, and heterocyclylene;

each R is independently hydrogen, or an optionally substituted group selected from $C_1$-$C_6$ aliphatic, carbocyclyl, aryl, heteroaryl, and heterocyclyl; and each

independently represents a connection to a nucleoside.

In some embodiments, L is a covalent bond or an optionally substituted, linear or branched $C_1$-$C_{10}$ alkylene, wherein one or more methylene units of L are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—;

$R^1$ is halogen, R, or an optionally substituted $C_1$-$C_{50}$ aliphatic wherein one or more methylene units are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—;

each R' is independently —R, —C(O)R, —$CO_2$R, or —$SO_2$R, or:

two R' on the same nitrogen are taken together with their intervening atoms to form an optionally substituted heterocyclic or heteroaryl ring, or two R' on the same carbon are taken together with their intervening atoms to form an optionally substituted aryl, carbocyclic, heterocyclic, or heteroaryl ring;

-Cy- is an optionally substituted bivalent ring selected from phenylene, carbocyclylene, arylene, heteroarylene, or heterocyclylene;

each R is independently hydrogen, or an optionally substituted group selected from $C_1$-$C_6$ aliphatic, phenyl, carbocyclyl, aryl, heteroaryl, or heterocyclyl; and each

independently represents a connection to a nucleoside.

In some embodiments, a chirally controlled oligonucleotide comprises one or more modified internucleotidic phosphorus linkages. In some embodiments, a chirally controlled oligonucleotide comprises, e.g., a phosphorothioate or a phosphorothioate triester linkage. In some embodiments, a chirally controlled oligonucleotide comprises a phosphorothioate triester linkage. In some embodiments, a chirally controlled oligonucleotide comprises at least two phosphorothioate triester linkages. In some embodiments, a chirally controlled oligonucleotide comprises at least three phosphorothioate triester linkages. In some embodiments, a chirally controlled oligonucleotide comprises at least four phosphorothioate triester linkages. In some embodiments, a chirally controlled oligonucleotide comprises at least five phosphorothioate triester linkages. Example modified internucleotidic phosphorus linkages are described further herein. In some embodiments, a chirally controlled oligonucleotide comprises different internucleotidic phosphorus linkages. In some embodiments, a chirally controlled oligonucleotide comprises at least one phosphate diester internucleotidic linkage and at least one modified internucleotidic linkage. In some embodiments, a chirally controlled oligonucleotide comprises at least one phosphate diester internucleotidic linkage and at least one phosphorothioate triester linkage. In some embodiments, a chirally controlled oligonucleotide comprises at least one phosphate diester internucleotidic linkage and at least two phosphorothioate triester linkages. In some embodiments, a chirally controlled oligonucleotide comprises at least one phosphate diester internucleotidic linkage and at least three phosphorothioate triester linkages. In some embodiments, a chirally controlled oligonucleotide comprises at least one phosphate diester internucleotidic linkage and at least four phosphorothioate triester linkages.

In some embodiments, P* is an asymmetric phosphorus atom and is either Rp or Sp. In some embodiments, P* is Rp. In other embodiments, P* is Sp. In some embodiments, an oligonucleotide comprises one or more internucleotidic linkages of formula I wherein each P* is independently Rp or Sp. In some embodiments, an oligonucleotide comprises one or more internucleotidic linkages of formula I wherein each P* is Rp. In some embodiments, an oligonucleotide comprises one or more internucleotidic linkages of formula I wherein each P* is Sp. In some embodiments, an oligonucleotide comprises at least one internucleotidic linkage of formula I wherein P* is Rp. In some embodiments, an oligonucleotide comprises at least one internucleotidic linkage of formula I wherein P* is Sp. In some embodiments, an oligonucleotide comprises at least one internucleotidic linkage of formula I wherein P* is Rp, and at least one internucleotidic linkage of formula I wherein P* is Sp.

In some embodiments, W is O, S, or Se. In some embodiments, W is O. In some embodiments, W is S. In some embodiments, W is Se. In some embodiments, an oligonucleotide comprises at least one internucleotidic linkage of formula I wherein W is O. In some embodiments, an oligonucleotide comprises at least one internucleotidic linkage of formula I wherein W is S. In some embodiments, an oligonucleotide comprises at least one internucleotidic linkage of formula I wherein W is Se.

In some embodiments, an oligonucleotide comprises at least one internucleotidic linkage of formula I wherein W is O. In some embodiments, an oligonucleotide comprises at least one internucleotidic linkage of formula I wherein W is S.

In some embodiments, each R is independently hydrogen, or an optionally substituted group selected from $C_1$-$C_6$ aliphatic, phenyl, carbocyclyl, aryl, heteroaryl, or heterocyclyl.

In some embodiments, R is hydrogen. In some embodiments, R is an optionally substituted group selected from $C_1$-$C_6$ aliphatic, phenyl, carbocyclyl, aryl, heteroaryl, or heterocyclyl.

In some embodiments, R is an optionally substituted $C_1$-$C_6$ aliphatic. In some embodiments, R is an optionally substituted $C_1$-$C_6$ alkyl. In some embodiments, R is optionally substituted, linear or branched hexyl. In some embodiments, R is optionally substituted, linear or branched pentyl. In some embodiments, R is optionally substituted, linear or branched butyl. In some embodiments, R is optionally substituted, linear or branched propyl. In some embodiments, R is optionally substituted ethyl. In some embodiments, R is optionally substituted methyl.

In some embodiments, R is optionally substituted phenyl. In some embodiments, R is substituted phenyl. In some embodiments, R is phenyl.

In some embodiments, R is optionally substituted carbocyclyl. In some embodiments, R is optionally substituted $C_3$-$C_{10}$ carbocyclyl. In some embodiments, R is optionally substituted monocyclic carbocyclyl. In some embodiments, R is optionally substituted cycloheptyl. In some embodiments, R is optionally substituted cyclohexyl. In some embodiments, R is optionally substituted cyclopentyl. In some embodiments, R is optionally substituted cyclobutyl. In some embodiments, R is an optionally substituted cyclopropyl. In some embodiments, R is optionally substituted bicyclic carbocyclyl.

In some embodiments, R is an optionally substituted aryl. In some embodiments, R is an optionally substituted bicyclic aryl ring.

In some embodiments, R is an optionally substituted heteroaryl. In some embodiments, R is an optionally substituted 5-6 membered monocyclic heteroaryl ring having 1-3 heteroatoms independently selected from nitrogen, sulfur, or oxygen. In some embodiments, R is a substituted 5-6 membered monocyclic heteroaryl ring having 1-3 heteroatoms independently selected from nitrogen, oxygen, or sulfur. In some embodiments, R is an unsubstituted 5-6 membered monocyclic heteroaryl ring having 1-3 heteroatoms independently selected from nitrogen, sulfur, or oxygen.

In some embodiments, R is an optionally substituted 5 membered monocyclic heteroaryl ring having 1-3 heteroatoms independently selected from nitrogen, oxygen or sulfur. In some embodiments, R is an optionally substituted 6 membered monocyclic heteroaryl ring having 1-3 heteroatoms independently selected from nitrogen, oxygen, or sulfur.

In some embodiments, R is an optionally substituted 5-membered monocyclic heteroaryl ring having 1 heteroatom selected from nitrogen, oxygen, or sulfur. In some embodiments, R is selected from pyrrolyl, furanyl, or thienyl.

In some embodiments, R is an optionally substituted 5-membered heteroaryl ring having 2 heteroatoms independently selected from nitrogen, oxygen, or sulfur. In certain embodiments, R is an optionally substituted 5-membered heteroaryl ring having 1 nitrogen atom, and an additional heteroatom selected from sulfur or oxygen. Example R groups include optionally substituted pyrazolyl, imidazolyl, thiazolyl, isothiazolyl, oxazolyl or isoxazolyl.

In some embodiments, R is a 6-membered heteroaryl ring having 1-3 nitrogen atoms. In other embodiments, R is an optionally substituted 6-membered heteroaryl ring having 1-2 nitrogen atoms. In some embodiments, R is an optionally substituted 6-membered heteroaryl ring having 2 nitrogen atoms. In certain embodiments, R is an optionally substituted 6-membered heteroaryl ring having 1 nitrogen. Example R groups include optionally substituted pyridinyl, pyrimidinyl, pyrazinyl, pyridazinyl, triazinyl, or tetrazinyl.

In certain embodiments, R is an optionally substituted 8-10 membered bicyclic heteroaryl ring having 1-4 heteroatoms independently selected from nitrogen, oxygen, or sulfur. In some embodiments, R is an optionally substituted 5,6-fused heteroaryl ring having 1-4 heteroatoms independently selected from nitrogen, oxygen, or sulfur. In other embodiments, R is an optionally substituted 5,6-fused heteroaryl ring having 1-2 heteroatoms independently selected from nitrogen, oxygen, or sulfur. In certain embodiments, R is an optionally substituted 5,6-fused heteroaryl ring having 1 heteroatom independently selected from nitrogen, oxygen, or sulfur. In some embodiments, R is an optionally substituted indolyl. In some embodiments, R is an optionally substituted azabicyclo[3.2.1]octanyl. In certain embodiments, R is an optionally substituted 5,6-fused heteroaryl ring having 2 heteroatoms independently selected from nitrogen, oxygen, or sulfur. In some embodiments, R is an optionally substituted azaindolyl. In some embodiments, R is an optionally substituted benzimidazolyl. In some embodiments, R is an optionally substituted benzothiazolyl. In some embodiments, R is an optionally substituted benzoxazolyl. In some embodiments, R is an optionally substituted indazolyl. In certain embodiments, R is an optionally substituted 5,6-fused heteroaryl ring having 3 heteroatoms independently selected from nitrogen, oxygen, or sulfur.

In certain embodiments, R is an optionally substituted 6,6-fused heteroaryl ring having 1-4 heteroatoms independently selected from nitrogen, oxygen, or sulfur. In some embodiments, R is an optionally substituted 6,6-fused heteroaryl ring having 1-2 heteroatoms independently selected from nitrogen, oxygen, or sulfur. In other embodiments, R is an optionally substituted 6,6-fused heteroaryl ring having 1 heteroatom independently selected from nitrogen, oxygen, or sulfur. In some embodiments, R is an optionally substituted quinolinyl. In some embodiments, R is an optionally substituted isoquinolinyl. According to one aspect, R is an optionally substituted 6,6-fused heteroaryl ring having 2 heteroatoms independently selected from nitrogen, oxygen, or sulfur. In some embodiments, R is a quinazoline or a quinoxaline.

In some embodiments, R is an optionally substituted heterocyclyl. In some embodiments, R is an optionally substituted 3-7 membered saturated or partially unsaturated heterocyclic ring having 1-2 heteroatoms independently selected from nitrogen, oxygen, or sulfur. In some embodiments, R is a substituted 3-7 membered saturated or partially unsaturated heterocyclic ring having 1-2 heteroatoms independently selected from nitrogen, oxygen, or sulfur. In some embodiments, R is an unsubstituted 3-7 membered saturated or partially unsaturated heterocyclic ring having 1-2 heteroatoms independently selected from nitrogen, oxygen, or sulfur.

In some embodiments, R is an optionally substituted heterocyclyl. In some embodiments, R is an optionally substituted 6 membered saturated or partially unsaturated heterocyclic ring having 1-2 heteroatoms independently selected from nitrogen, oxygen, or sulfur. In some embodiments, R is an optionally substituted 6 membered partially unsaturated heterocyclic ring having 2 heteroatoms independently selected from nitrogen, oxygen, or sulfur. In some embodiments, R is an optionally substituted 6 membered partially unsaturated heterocyclic ring having 2 oxygen atom.

In certain embodiments, R is a 3-7 membered saturated or partially unsaturated heterocyclic ring having 1-2 heteroatoms independently selected from nitrogen, oxygen, or sulfur. In certain embodiments, R is oxiranyl, oxetanyl, tetrahydrofuranyl, tetrahydropyranyl, oxepaneyl, aziridineyl, azetidineyl, pyrrolidinyl, piperidinyl, azepanyl, thiiranyl, thietanyl, tetrahydrothiophenyl, tetrahydrothiopyranyl, thiepanyl, dioxolanyl, oxathiolanyl, oxazolidinyl, imidazolidinyl, thiazolidinyl, dithiolanyl, dioxanyl, morpholinyl, oxathianyl, piperazinyl, thiomorpholinyl, dithianyl, dioxepanyl, oxazepanyl, oxathiepanyl, dithiepanyl, diazepanyl, dihydrofuranonyl, tetrahydropyranonyl, oxepanonyl, pyrolidinonyl, piperidinonyl, azepanonyl, dihydrothiophenonyl, tetrahydrothiopyranonyl, thiepanonyl, oxazolidinonyl, oxazinanonyl, oxazepanonyl, dioxolanonyl, dioxanonyl, dioxepanonyl, oxathiolinonyl, oxathianonyl, oxathiepanonyl, thiazolidinonyl, thiazinanonyl, thiazepanonyl, imidazolidinonyl, tetrahydropyrimidinonyl, diazepanonyl, imidazolidinedionyl, oxazolidinedionyl, thiazolidinedionyl, dioxolanedionyl, oxathiolanedionyl, piperazinedionyl, morpholinedionyl, thiomorpholinedionyl, tetrahydropyranyl, tetrahydrofuranyl, morpholinyl, thiomorpholinyl, piperidinyl, piperazinyl, pyrrolidinyl, tetrahydrothiophenyl, or tetrahydrothiopyranyl. In some embodiments, R is an optionally substituted 5 membered saturated or partially unsaturated heterocyclic ring having 1-2 heteroatoms independently selected from nitrogen, oxygen, or sulfur.

In certain embodiments, R is an optionally substituted 5-6 membered partially unsaturated monocyclic ring having 1-2 heteroatoms independently selected from nitrogen, oxygen, or sulfur. In certain embodiments, R is an optionally substituted tetrahydropyridinyl, dihydrothiazolyl, dihydrooxazolyl, or oxazolinyl group.

In some embodiments, R is an optionally substituted 8-10 membered bicyclic saturated or partially unsaturated heterocyclic ring having 1-4 heteroatoms independently selected from nitrogen, oxygen, or sulfur. In some embodiments, R is an optionally substituted indolinyl. In some embodiments, R is an optionally substituted isoindolinyl. In some embodiments, R is an optionally substituted 1, 2, 3, 4-tetrahydroquinoline. In some embodiments, R is an optionally substituted 1, 2, 3, 4-tetrahydroisoquinoline.

In some embodiments, each R' is independently —R, —C(O)R, —$CO_2$R, or —$SO_2$R, or:

two R' on the same nitrogen are taken together with their intervening atoms to form an optionally substituted heterocyclic or heteroaryl ring, or two R' on the same carbon are taken together with their intervening atoms to form an optionally substituted aryl, carbocyclic, heterocyclic, or heteroaryl ring.

In some embodiments, R' is —R, —C(O)R, —$CO_2$R, or —$SO_2$R, wherein R is as defined above and described herein.

In some embodiments, R' is —R, wherein R is as defined and described above and herein. In some embodiments, R' is hydrogen.

In some embodiments, R' is —C(O)R, wherein R is as defined above and described herein. In some embodiments, R' is —$CO_2$R, wherein R is as defined above and described herein. In some embodiments, R' is —$SO_2$R, wherein R is as defined above and described herein.

In some embodiments, two R' on the same nitrogen are taken together with their intervening atoms to form an optionally substituted heterocyclic or heteroaryl ring. In some embodiments, two R' on the same carbon are taken together with their intervening atoms to form an optionally substituted aryl, carbocyclic, heterocyclic, or heteroaryl ring.

In some embodiments, -Cy- is an optionally substituted bivalent ring selected from phenylene, carbocyclylene, arylene, heteroarylene, or heterocyclylene.

In some embodiments, -Cy- is optionally substituted phenylene. In some embodiments, -Cy- is optionally substituted carbocyclylene. In some embodiments, -Cy- is optionally substituted arylene. In some embodiments, -Cy- is optionally substituted heteroarylene. In some embodiments, -Cy- is optionally substituted heterocyclylene.

In some embodiments, each of X, Y and Z is independently —O—, —S—, —N(-L-$R^1$)—, or L, wherein each of L and $R^1$ is independently as defined above and described below.

In some embodiments, X is —O—. In some embodiments, X is —S—. In some embodiments, X is —O— or —S—. In some embodiments, an oligonucleotide comprises at least one internucleotidic linkage of formula I wherein X is —O—. In some embodiments, an oligonucleotide comprises at least one internucleotidic linkage of formula I wherein X is —S—. In some embodiments, an oligonucleotide comprises at least one internucleotidic linkage of formula I wherein X is —O—, and at least one internucleotidic linkage of formula I wherein X is —S—. In some embodiments, an oligonucleotide comprises at least one internucleotidic linkage of formula I wherein X is —O—, and at least one internucleotidic linkage of formula I wherein X is —S—, and at least one internucleotidic linkage of formula I wherein L is an optionally substituted, linear or branched $C_1$-$C_{10}$ alkylene, wherein one or more methylene units of L are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—.

In some embodiments, X is —N(-L-$R^1$)—. In some embodiments, X is —N(R')—. In some embodiments, X is —N(R')—. In some embodiments, X is —N(R)—. In some embodiments, X is —NH—.

In some embodiments, X is L. In some embodiments, X is a covalent bond. In some embodiments, X is or an optionally substituted, linear or branched $C_1$-$C_{10}$ alkylene, wherein one or more methylene units of L are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—. In some embodiments, X is an optionally substituted $C_1$-$C_{10}$ alkylene or $C_1$-$C_{10}$ alkenylene. In some embodiments, X is methylene.

In some embodiments, Y is —O—. In some embodiments, Y is —S—.

In some embodiments, Y is —N(-L-$R^1$)—. In some embodiments, Y is —N(R')—. In some embodiments, Y is —N(R')—. In some embodiments, Y is —N(R)—. In some embodiments, Y is —NH—.

In some embodiments, Y is L. In some embodiments, Y is a covalent bond. In some embodiments, Y is or an optionally substituted, linear or branched $C_1$-$C_{10}$ alkylene, wherein one or more methylene units of L are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—. In some embodiments, Y is an optionally substituted $C_1$-$C_{10}$ alkylene or $C_1$-$C_{10}$ alkenylene. In some embodiments, Y is methylene.

In some embodiments, Z is —O—. In some embodiments, Z is —S—.

In some embodiments, Z is —N(-L-$R^1$)—. In some embodiments, Z is —N(R')—. In some embodiments, Z is —N(R')—. In some embodiments, Z is —N(R)—. In some embodiments, Z is —NH—.

In some embodiments, Z is L. In some embodiments, Z is a covalent bond. In some embodiments, Z is or an optionally substituted, linear or branched $C_1$-$C_{10}$ alkylene, wherein one or more methylene units of L are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—. In some embodiments, Z is an optionally substituted $C_1$-$C_{10}$ alkylene or $C_1$-$C_{10}$ alkenylene. In some embodiments, Z is methylene.

In some embodiments, L is a covalent bond or an optionally substituted, linear or branched $C_1$-$C_{10}$ alkylene, wherein one or more methylene units of L are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—.

In some embodiments, L is a covalent bond. In some embodiments, L is an optionally substituted, linear or branched $C_1$-$C_{10}$ alkylene, wherein one or more methylene units of L are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—.

In some embodiments, L has the structure of -$L^1$-V—, wherein:

$L^1$ is an optionally substituted group selected from

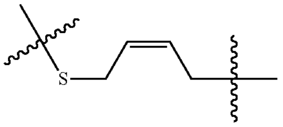
,
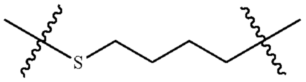
,
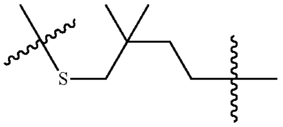
,
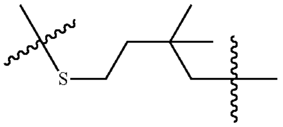
,
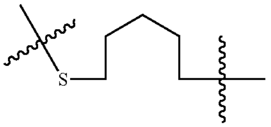
,
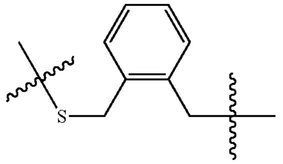
, -continued

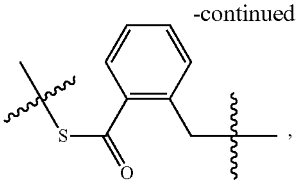
,
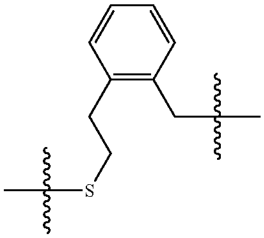
,
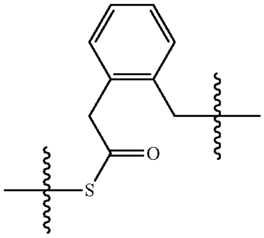
, $C_1$-$C_6$ alkylene, $C_1$-$C_6$ alkenylene, carbocyclylene, arylene, $C_1$-$C_6$ heteroalkylene, heterocyclylene, and heteroarylene;

V is selected from —O—, —S—, —NR'—, C(R')$_2$, —S—S—, —B—S—S—C—,

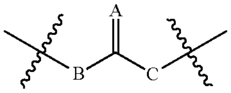
, or an optionally substituted group selected from $C_1$-$C_6$ alkylene, arylene, $C_1$-$C_6$ heteroalkylene, heterocyclylene, and heteroarylene;

A is =O, =S, =NR', or =C(R')$_2$;

each of B and C is independently —O—, —S—, —NR'—, —C(R')$_2$—, or an optionally substituted group selected from $C_1$-$C_6$ alkylene, carbocyclylene, arylene, heterocyclylene, or heteroarylene; and each R' is independently as defined above and described herein.

In some embodiments, $L^1$ is

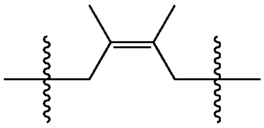
,
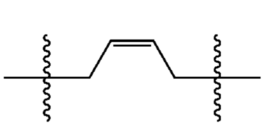
,
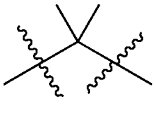
,
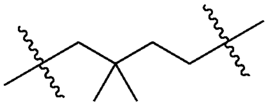
,
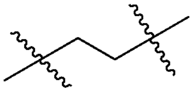
,

-continued

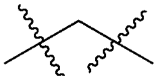, or 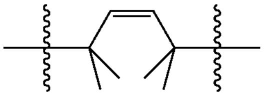.

In some embodiments, $L^1$ is

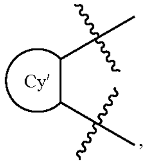 [SMILES: *CC*], wherein Ring Cy' is an optionally substituted arylene, carbocyclylene, heteroarylene, or heterocyclylene. In some embodiments, $L^1$ is optionally substituted

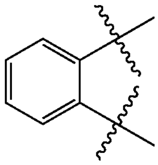.

In some embodiments, $L^1$ is

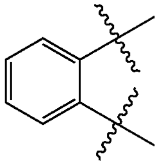.

In some embodiments, $L^1$ is connected to X. In some embodiments, $L^1$ is an optionally substituted group selected from

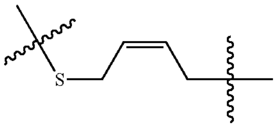,

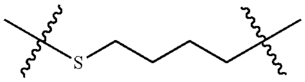,

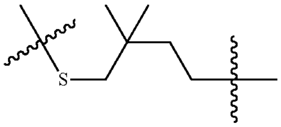,

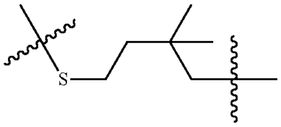,

-continued

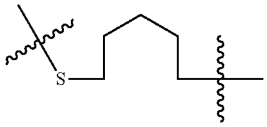,

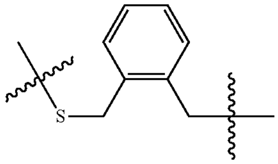,

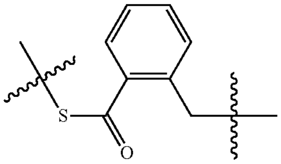,

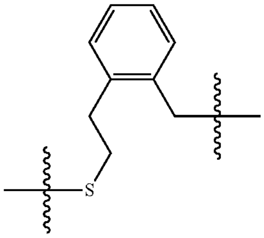, and

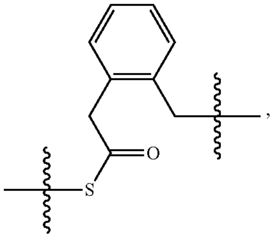, and the sulfur atom is connect to V. In some embodiments, $L^1$ is an optionally substituted group selected from

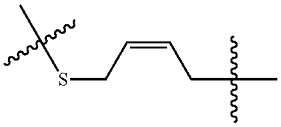,

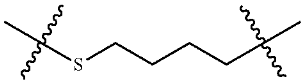,

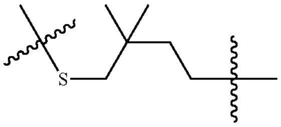,

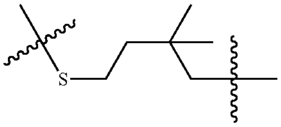,

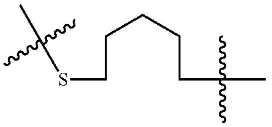,

-continued

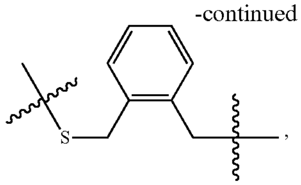

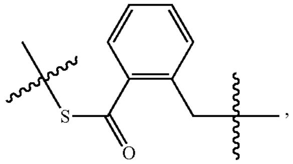

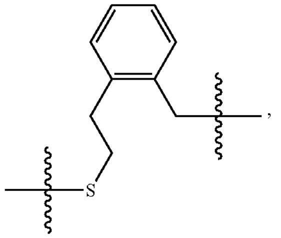

and

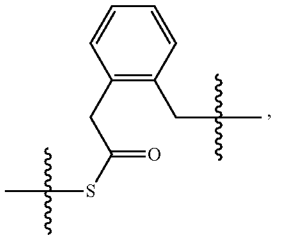

and the carbon atom is connect to X.

In some embodiments, L has the structure of:

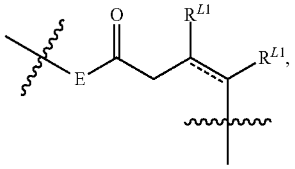

wherein:

⎓ is —O—, —S—, —NR'— or —C(R')$_2$—; a single or double bond;

the two $R^{L1}$ are taken together with the two carbon atoms to which they are bound to form an optionally substituted aryl, carbocyclic, heteroaryl or heterocyclic ring; and each R' is independently as defined above and described herein.

In some embodiments, L has the structure of:

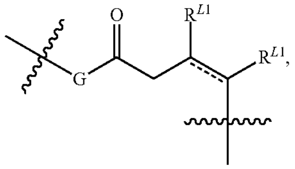

wherein:

G is —O—, —S—, or —NR';

⎓ is a single or double bond; and the two $R^{L1}$ are taken together with the two carbon atoms to which they are bound to form an optionally substituted aryl, $C_3$-$C_{10}$ carbocyclic, heteroaryl or heterocyclic ring.

In some embodiments, L has the structure of:

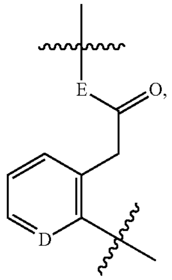

wherein:

E is —O—, —S—, —NR'— or —C(R')$_2$—;

D is =N—, =C(F)—, =C(Cl)—, =C(Br)—, =C(I)—, =C(CN)—, =C($NO_2$)—, =C($CO_2$—($C_1$-$C_6$ aliphatic))-, or =C($CF_3$)—; and each R' is independently as defined above and described herein.

In some embodiments, L has the structure of:

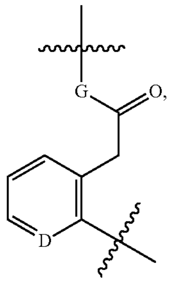

wherein:

G is —O—, —S—, or —NR';

D is =N—, =C(F)—, =C(Cl)—, =C(Br)—, =C(I)—, =C(CN)—, =C($NO_2$)—, =C($CO_2$—($C_1$-$C_6$ aliphatic))-, or =C($CF_3$)—.

In some embodiments, L has the structure of:

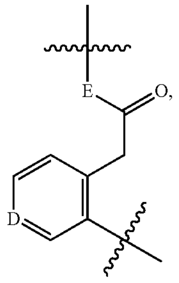

wherein:

E is —O—, —S—, —NR'— or —C(R')$_2$—;

D is =N—, =C(F)—, =C(Cl)—, =C(Br)—, =C(I)—, =C(CN)—, =C($NO_2$)—, =C($CO_2$—($C_1$-$C_6$ aliphatic))-, or =C($CF_3$)—; and each R' is independently as defined above and described herein.

In some embodiments, L has the structure of:

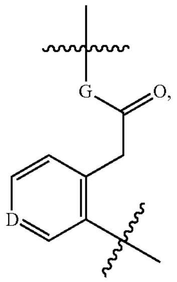

wherein:

G is —O—, —S—, or —NR';

D is =N—, =C(F)—, =C(Cl)—, =C(Br)—, =C(I)—, =C(CN)—, =C($NO_2$)—, =C($CO_2$—($C_1$-$C_6$ aliphatic))-, or =C($CF_3$)—.

In some embodiments, L has the structure of:

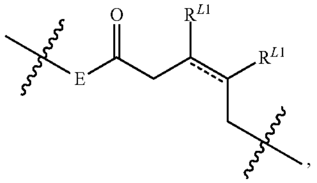

wherein:

E is —O—, —S—, —NR'— or —C($R'$)$_2$—;

⎓ is a single or double bond;

the two $R^{L1}$ are taken together with the two carbon atoms to which they are bound to form an optionally substituted aryl, $C_3$-$C_{10}$ carbocyclic, heteroaryl or heterocyclic ring;

and each R' is independently as defined above and described herein.

In some embodiments L has the structure of:

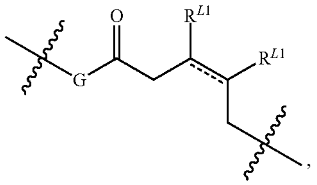

wherein:

G is —O—, —S—, or —NR';

⎓ is a single or double bond;

the two $R^{L1}$ are taken together with the two carbon atoms to which they are bound to form an optionally substituted aryl, $C_3$-$C_{10}$ carbocyclic, heteroaryl or heterocyclic ring;

and each R' is independently as defined above and described herein.

In some embodiments, L has the structure of:

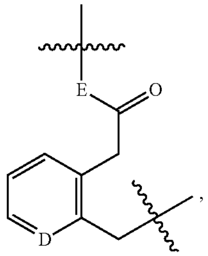

wherein:

E is —O—, —S—, —NR'— or —C($R'$)$_2$—;

D is =N—, =C(F)—, =C(Cl)—, =C(Br)—, =C(I)—, =C(CN)—, =C($NO_2$)—, =C($CO_2$—($C_1$-$C_6$ aliphatic))-, or =C($CF_3$)—; and each R' is independently as defined above and described herein.

In some embodiments, L has the structure of:

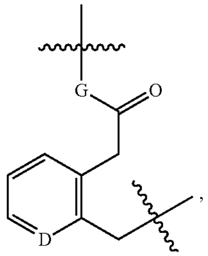

wherein:

G is —O—, —S—, or —NR';

D is =N—, =C(F)—, =C(Cl)—, =C(Br)—, =C(I)—, =C(CN)—, =C($NO_2$)—, =C($CO_2$—($C_1$-$C_6$ aliphatic))-, or =C($CF_3$)—; and each R' is independently as defined above and described herein.

In some embodiments, L has the structure of:

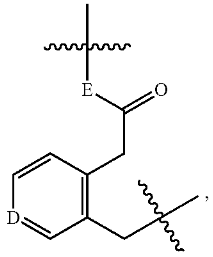

wherein:

E is —O—, —S—, —NR'— or —C($R'$)$_2$—;

D is =N—, =C(F)—, =C(Cl)—, =C(Br)—, =C(I)—, =C(CN)—, =C($NO_2$)—, =C($CO_2$—($C_1$-$C_6$ aliphatic))-, or =C($CF_3$)—; and each R' is independently as defined above and described herein.

In some embodiments, L has the structure of:

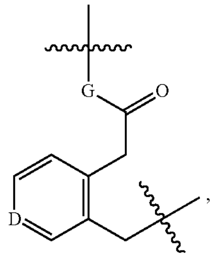

wherein:

G is —O—, —S—, or —NR';

D is =N—, =C(F)—, =C(Cl)—, =C(Br)—, =C(I)—, =C(CN)—, =C($NO_2$)—, =C($CO_2$—($C_1$-$C_6$ aliphatic))-, or =C($CF_3$)—; and each R' is independently as defined above and described herein.

In some embodiments, L has the structure of:

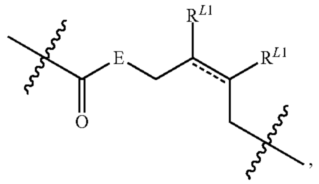

wherein:

E is —O—, —S—, —NR'— or —C($R'$)$_2$—;

⎓ is a single or double bond;

the two $R^{L1}$ are taken together with the two carbon atoms to which they are bound to form an optionally substituted aryl, $C_3$-$C_{10}$ carbocyclic, heteroaryl or heterocyclic ring; and each R' is independently as defined above and described herein.

In some embodiments, L has the structure of:

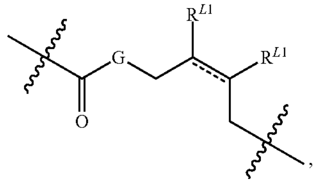

wherein:

G is —O—, —S—, or —NR';

⎓ is a single or double bond;

the two $R^{L1}$ are taken together with the two carbon atoms to which they are bound to form an optionally substituted aryl, $C_3$-$C_{10}$ carbocyclic, heteroaryl or heterocyclic ring; and each R' is independently as defined above and described herein.

In some embodiments, L has the structure of:

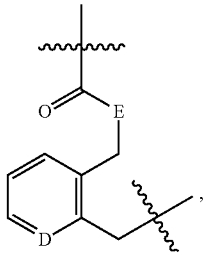

wherein:

E is —O—, —S—, —NR'— or —C($R'$)$_2$—;

D is =N—, =C(F)—, =C(Cl)—, =C(Br)—, =C(I)—, =C(CN)—, =C($NO_2$)—, =C($CO_2$—($C_1$-$C_6$ aliphatic))-, or =C($CF_3$)—; and each R' is independently as defined above and described herein.

In some embodiments, L has the structure of:

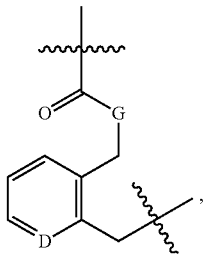

wherein:

G is —O—, —S—, or —NR';

D is =N—, =C(F)—, =C(Cl)—, =C(Br)—, =C(I)—, =C(CN)—, =C($NO_2$)—, =C($CO_2$—($C_1$-$C_6$ aliphatic))-, or =C($CF_3$)—; and R' is as defined above and described herein.

In some embodiments, L has the structure of:

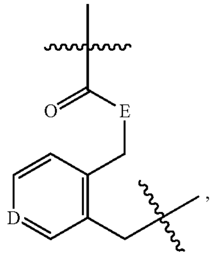

wherein:

E is —O—, —S—, —NR'— or —C($R'$)$_2$—;

D is =N—, =C(F)—, =C(Cl)—, =C(Br)—, =C(I)—, =C(CN)—, =C($NO_2$)—, =C($CO_2$—($C_1$-$C_6$ aliphatic))-, or =C($CF_3$)—; and each R' is independently as defined above and described herein.

In some embodiments, L has the structure of:

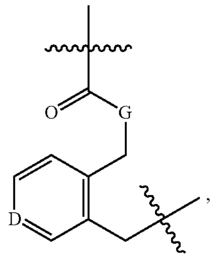

wherein:

G is —O—, —S—, or —NR';

D is =N—, =C(F)—, =C(Cl)—, =C(Br)—, =C(I)—, =C(CN)—, =C($NO_2$)—, =C($CO_2$—($C_1$-$C_6$ aliphatic))-, or =C($CF_3$)—; and R' is as defined above and described herein.

In some embodiments, L has the structure of:

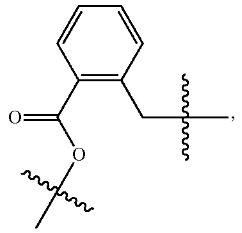 [SMILES: *Cc1ccccc1C(=O)O*]

wherein the phenyl ring is optionally substituted. In some embodiments, the phenyl ring is not substituted. In some embodiments, the phenyl ring is substituted.

In some embodiments, L has the structure of:

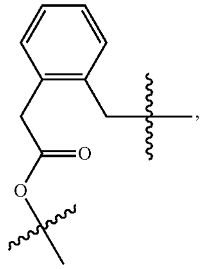 [SMILES: *Cc1ccccc1CC(=O)O*]

wherein the phenyl ring is optionally substituted. In some embodiments, the phenyl ring is not substituted. In some embodiments, the phenyl ring is substituted.

In some embodiments, L has the structure of:

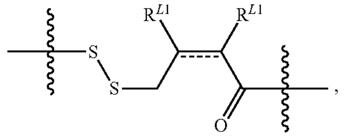

wherein:

⎓ is a single or double bond; and the two $R^{L1}$ are taken together with the two carbon atoms to which they are bound to form an optionally substituted aryl, $C_3$-$C_{10}$ carbocyclic, heteroaryl or heterocyclic ring.

In some embodiments, L has the structure of:

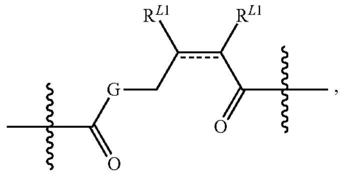

wherein:

G is —O—, —S—, or —NR';

⎓ is a single or double bond; and the two $R^{L1}$ are taken together with the two carbon atoms to which they are bound to form an optionally substituted aryl, $C_3$-$C_{10}$ carbocyclic, heteroaryl or heterocyclic ring.

In some embodiments, E is —O—, —S—, —NR'— or —C(R')$_2$—, wherein each R' independently as defined above and described herein. In some embodiments, E is —O—, —S—, or —NR'—. In some embodiments, E is —O—, —S—, or —NH—. In some embodiments, E is —O—. In some embodiments, E is —S—. In some embodiments, E is —NH—.

In some embodiments, G is —O—, —S—, or —NR', wherein each R' independently as defined above and described herein. In some embodiments, G is —O—, —S—, or —NH—. In some embodiments, G is —O—. In some embodiments, G is —S—. In some embodiments, G is —NH—.

In some embodiments, L is -$L^3$-G-, wherein:

$L^3$ is an optionally substituted $C_1$-$C_5$ alkylene or alkenylene, wherein one or more methylene units are optionally and independently replaced by —O—, —S—, —N(R')—, —C(O)—, —C(S)—, —C(NR')—, —S(O)—, —S(O)$_2$—,

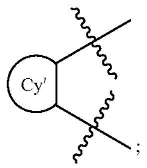 [SMILES: *CC*]

and wherein each of G, R' and Ring Cy' is independently as defined above and described herein.

In some embodiments, L is -$L^3$-S—, wherein $L^3$ is as defined above and described herein. In some embodiments, L is -$L^3$-O—, wherein $L^3$ is as defined above and described herein. In some embodiments, L is -$L^3$-N(R')—, wherein each of $L^3$ and R' is independently as defined above and described herein. In some embodiments, L is -$L^3$-NH—, wherein each of $L^3$ and R' is independently as defined above and described herein.

In some embodiments, $L^3$ is an optionally substituted $C_5$ alkylene or alkenylene, wherein one or more methylene units are optionally and independently replaced by —O—, —S—, —N(R')—, —C(O)—, —C(S)—, —C(NR')—, —S(O)—, —S(O)$_2$—, or In some embodiments, L has the structure of:

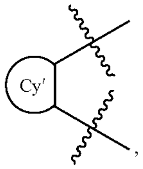 [SMILES: *CC*]

and each of R' and Ring Cy' is independently as defined above and described herein. In some embodiments, $L^3$ is an optionally substituted $C_5$ alkylene. In some embodiments, $-L^3$-G- is

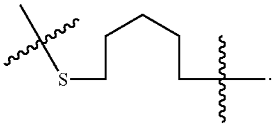 [SMILES: *CCCCCS*]

In some embodiments, $L^3$ is an optionally substituted $C_4$ alkylene or alkenylene, wherein one or more methylene units are optionally and independently replaced by —O—, —S—, —N(R')—, —C(O)—, —C(S)—, —C(NR')—, —S(O)—, —$S(O)_2$—, or

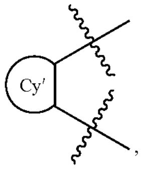 [SMILES: *CC*]

and each of R' and Cy' is independently as defined above and described herein.

In some embodiments, $-L^3$-G- is

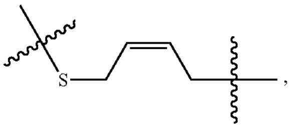

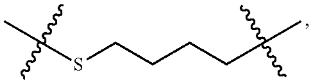

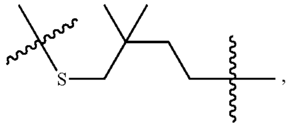

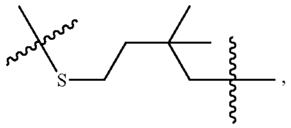

-continued

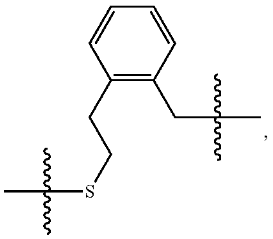

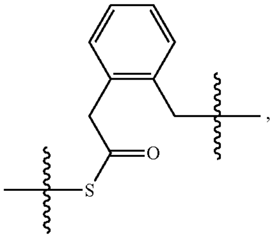

or

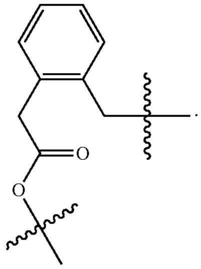

In some embodiments, $L^3$ is an optionally substituted $C_3$ alkylene or alkenylene, wherein one or more methylene units are optionally and independently replaced by —O—, —S—, —N(R')—, —C(O)—, —C(S)—, —C(NR')—, —S(O)—, —$S(O)_2$—, or,

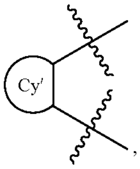 [SMILES: *CC*]

and each of R' and Cy' is independently as defined above and described herein.

In some embodiments, $-L^3$-G- is

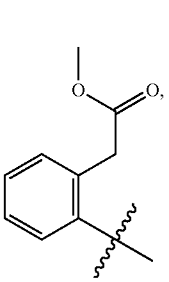

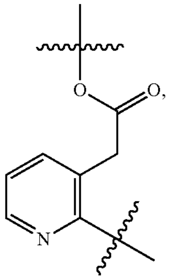

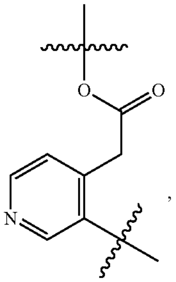

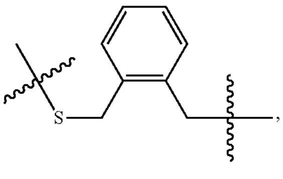

-continued

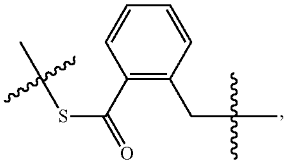

, or

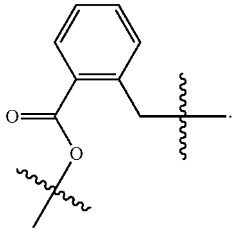

In some embodiments, L is

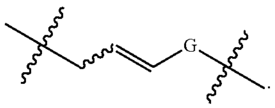

In some embodiments, L is

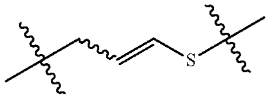

or

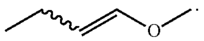

In some embodiments, L is

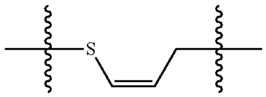

or

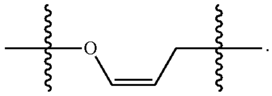

In some embodiments, $L^3$ is an optionally substituted $C_2$ alkylene or alkenylene, wherein one or more methylene units are optionally and independently replaced by —O—, —S—, —N(R')—, —C(O)—, —C(S)—, —C(NR')—, —S(O)—, —$S(O)_2$—, or

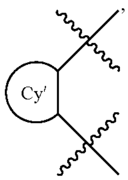 [SMILES: *CC*]

and each of R' and Cy' is independently as defined above and described herein.

In some embodiments, -$L^3$-G- is

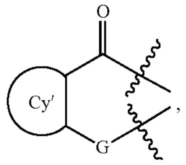

wherein each of G and Cy' is independently as defined above and described herein. In some embodiments, L is

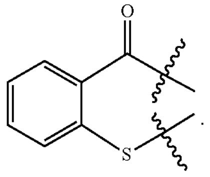 [SMILES: *Sc1ccccc1C(*)=O]

In some embodiments, L is -$L^4$-G-, wherein $L^4$ is an optionally substituted $C_1$-$C_2$ alkylene; and G is as defined above and described herein. In some embodiments, L is -$L^4$-G-, wherein $L^4$ is an optionally substituted $C_1$-$C_2$ alkylene; G is as defined above and described herein; and G is connected to $R^1$. In some embodiments, L is -$L^4$-G-, wherein $L^4$ is an optionally substituted methylene; G is as defined above and described herein; and G is connected to $R^1$. In some embodiments, L is -$L^4$-G-, wherein $L^4$ is methylene; G is as defined above and described herein; and G is connected to $R^1$. In some embodiments, L is -$L^4$-G-, wherein $L^4$ is an optionally substituted —$(CH_2)_2$—; G is as defined above and described herein; and G is connected to $R^1$. In some embodiments, L is -$L^4$-G-, wherein $L^4$ is —$(CH_2)_2$—; G is as defined above and described herein; and G is connected to $R^1$.

In some embodiments, L is

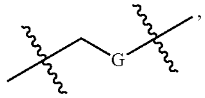

, or

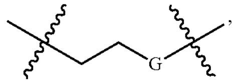

wherein G is as defined above and described herein, and G is connected to $R^1$. In some embodiments, L is

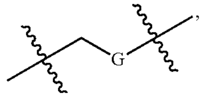

wherein G is as defined above and described herein, and G is connected to $R^1$. In some embodiments, L is

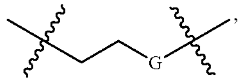

wherein G is as defined above and described herein, and G is connected to $R^1$. In some embodiments, L is

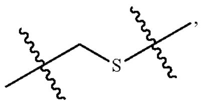
or
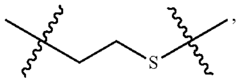

wherein the sulfur atom is connected to $R^1$. In some embodiments, L is

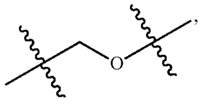
or
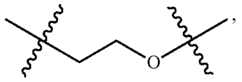

wherein the oxygen atom is connected to $R^1$.

In some embodiments, L is

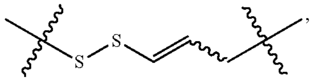
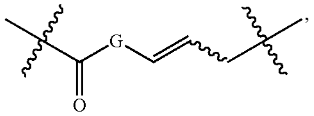
or
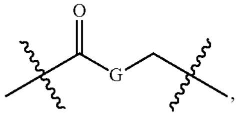

wherein G is as defined above and described herein.

In some embodiments, L is —S—$R^{L3}$— or —S—C(O)—$R^{L3}$—, wherein $R^{L3}$ is an optionally substituted, linear or branched, $C_1$-$C_9$ alkylene, wherein one or more methylene units are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—, wherein each of R' and -Cy- is independently as defined above and described herein. In some embodiments, L is —S—$R^{L3}$— or —S—C(O)—$R^{L3}$—, wherein $R^{L3}$ is an optionally substituted $C_1$-$C_6$ alkylene. In some embodiments, L is —S—$R^{L3}$— or —S—C(O)—$R^{L3}$—, wherein $R^{L3}$ is an optionally substituted $C_1$-$C_6$ alkenylene. In some embodiments, L is —S—$R^{L3}$— or —S—C(O)—$R^{L3}$—, wherein $R^{L3}$ is an optionally substituted $C_1$-$C_6$ alkylene wherein one or more methylene units are optionally and independently replaced by an optionally substituted $C_1$-$C_6$ alkenylene, arylene, or heteroarylene. In some embodiments, In some embodiments, $R^{L3}$ is an optionally substituted —S—($C_1$-$C_6$ alkenylene)-, —S—($C_1$-$C_6$ alkylene)-, —S—($C_1$-$C_6$ alkylene)-arylene-($C_1$-$C_6$ alkylene)-, —S—CO-arylene-($C_1$-$C_6$ alkylene)-, or —S—CO—($C_1$-$C_6$ alkylene)-arylene-($C_1$-$C_6$ alkylene)-.

In some embodiments, L is

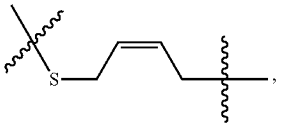
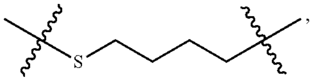
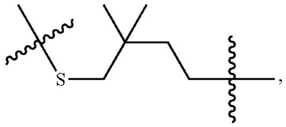
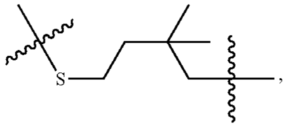
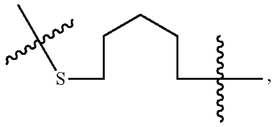
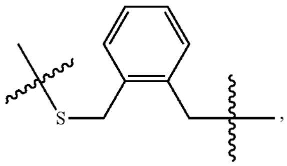
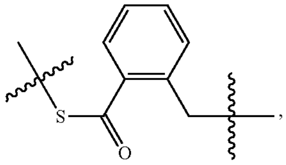
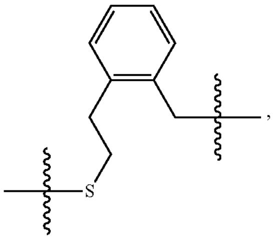
or
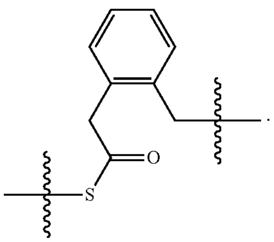

In some embodiments, L is

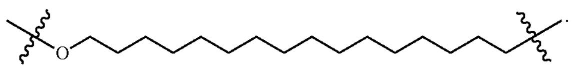 [SMILES: *CCCCCCCCCCCCCCCCO*]

In some embodiments, L is

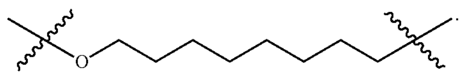 [SMILES: *CCCCCCCCO*]

In some embodiments,

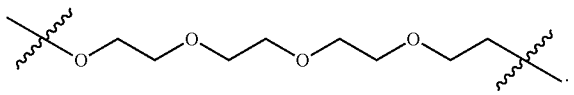 [SMILES: *CCOCCOCCOCCO*]

In some embodiments, the sulfur atom in the L embodiments described above and herein is connected to X. In some embodiments, the sulfur atom in the L embodiments described above and herein is connected to $R^1$.

In some embodiments, $R^1$ is halogen, R, or an optionally substituted $C_1$-$C_{50}$ aliphatic wherein one or more methylene units are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—, wherein each variable is independently as defined above and described herein. In some embodiments, $R^1$ is halogen, R, or an optionally substituted $C_1$-$C_{10}$ aliphatic wherein one or more methylene units are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—, wherein each variable is independently as defined above and described herein.

In some embodiments, $R^1$ is hydrogen. In some embodiments, $R^1$ is halogen. In some embodiments, $R^1$ is —F. In some embodiments, $R^1$ is —Cl. In some embodiments, $R^1$ is —Br. In some embodiments, $R^1$ is —I.

In some embodiments, $R^1$ is R wherein R is as defined above and described herein.

In some embodiments, $R^1$ is hydrogen. In some embodiments, $R^1$ is an optionally substituted group selected from $C_1$-$C_{50}$ aliphatic, phenyl, carbocyclyl, aryl, heteroaryl, or heterocyclyl.

In some embodiments, $R^1$ is an optionally substituted $C_1$-$C_{50}$ aliphatic. In some embodiments, $R^1$ is an optionally substituted $C_1$-$C_{10}$ aliphatic. In some embodiments, $R^1$ is an optionally substituted $C_1$-$C_6$ aliphatic. In some embodiments, $R^1$ is an optionally substituted $C_1$-$C_6$ alkyl. In some embodiments, $R^1$ is optionally substituted, linear or branched hexyl. In some embodiments, $R^1$ is optionally substituted, linear or branched pentyl. In some embodiments, $R^1$ is optionally substituted, linear or branched butyl.

In some embodiments, $R^1$ is optionally substituted, linear or branched propyl. In some embodiments, $R^1$ is optionally substituted ethyl. In some embodiments, $R^1$ is optionally substituted methyl.

In some embodiments, $R^1$ is optionally substituted phenyl. In some embodiments, $R^1$ is substituted phenyl. In some embodiments, $R^1$ is phenyl.

In some embodiments, $R^1$ is optionally substituted carbocyclyl. In some embodiments, $R^1$ is optionally substituted $C_3$-$C_{10}$ carbocyclyl. In some embodiments, $R^1$ is optionally substituted monocyclic carbocyclyl. In some embodiments, $R^1$ is optionally substituted cycloheptyl. In some embodiments, $R^1$ is optionally substituted cyclohexyl. In some embodiments, $R^1$ is optionally substituted cyclopentyl. In some embodiments, $R^1$ is optionally substituted cyclobutyl. In some embodiments, $R^1$ is an optionally substituted cyclopropyl. In some embodiments, $R^1$ is optionally substituted bicyclic carbocyclyl.

In some embodiments, $R^1$ is an optionally substituted $C_1$-$C_{50}$ polycyclic hydrocarbon. In some embodiments, $R^1$ is an optionally substituted $C_1$-$C_{50}$ polycyclic hydrocarbon wherein one or more methylene units are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—, wherein each variable is independently as defined above and described herein. In some embodiments, $R^1$ is optionally substituted

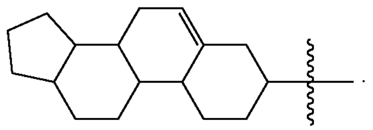 [SMILES: *C1CCC2C(=CCC3C4CCCC4CCC23)C1]

In some embodiments, $R^1$ is

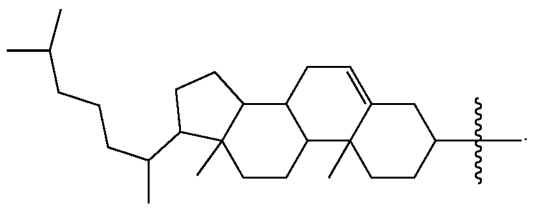 [SMILES: *C1CCC2(C)C(=CCC3C2CCC2(C)C(C(C)CCCC(C)C)CCC32)C1]

In some embodiments, $R^1$ is optionally substituted

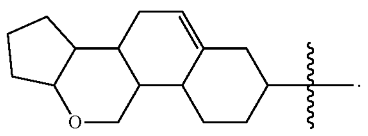

In some embodiments, $R^1$ is an optionally substituted $C_1$-$C_{50}$ aliphatic comprising one or more optionally substituted polycyclic hydrocarbon moieties. In some embodiments, $R^1$ is an optionally substituted $C_1$-$C_{50}$ aliphatic comprising one or more optionally substituted polycyclic hydrocarbon moieties, wherein one or more methylene units are optionally and independently replaced by an optionally substituted $C_1$-$C_6$ alkylene, $C_1$-$C_6$ alkenylene, —C≡C—, —$C(R')_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —$S(O)_2$—, —$S(O)_2N(R')$—, —$N(R')S(O)_2$—, —SC(O)—, —C(O)S—, —OC(O)—, or —C(O)O—, wherein each variable is independently as defined above and described herein. In some embodiments, $R^1$ is an optionally substituted $C_1$-$C_{50}$ aliphatic comprising one or more optionally substituted

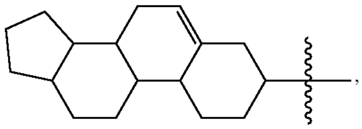 [SMILES: *C1CCC2C(=CCC3C4CCCC4OCC23)C1]

,

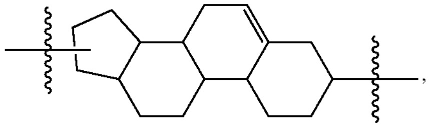

,

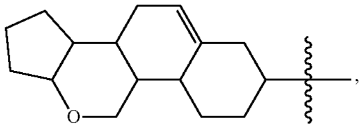

, or

-continued

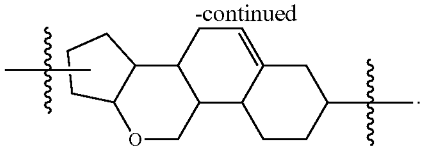

.

In some embodiments, $R^1$ is

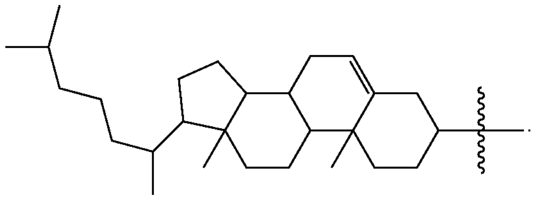 [SMILES: *C1CCC2(C)C(=CCC3C2CCC2(C)C(C(C)CCCC(C)C)CCC32)C1]

.

In some embodiments, $R^1$ is

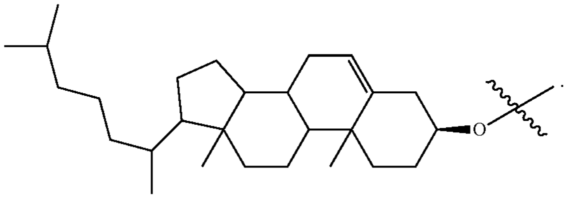 [SMILES: *O[C@H]1CCC2(C)C(=CCC3C2CCC2(C)C(C(C)CCCC(C)C)CCC32)C1]

.

In some embodiments, $R^1$ is

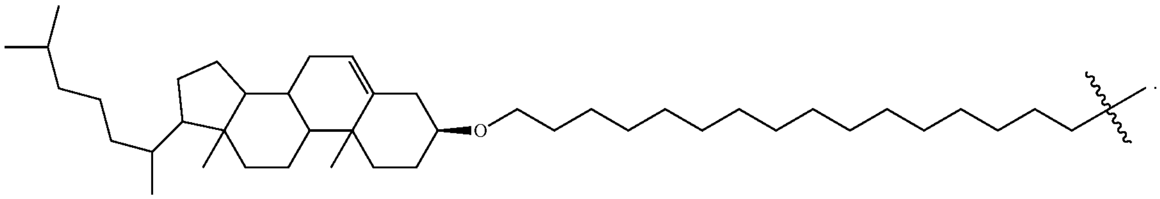 [SMILES: *CCCCCCCCCCCCCCCCO[C@H]1CCC2(C)C(=CCC3C2CCC2(C)C(C(C)CCCC(C)C)CCC32)C1]

.

In some embodiments, $R^1$ is

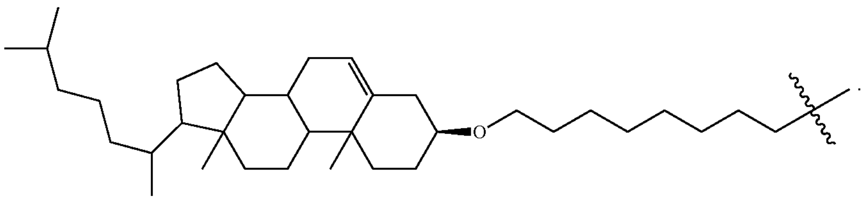 [SMILES: *CCCCCCCCO[C@H]1CCC2(C)C(=CCC3C2CCC2(C)C(C(C)CCCC(C)C)CCC32)C1]

.

In some embodiments, $R^1$ is

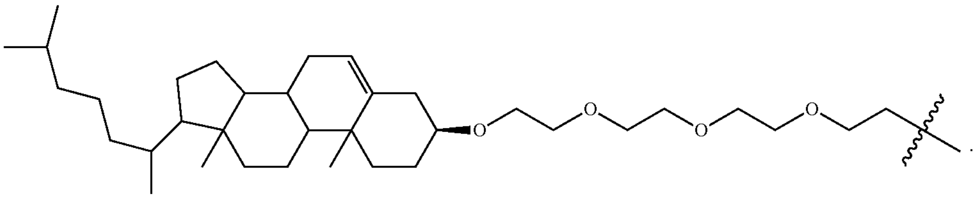 [SMILES: *CCOCCOCCOCCO[C@H]1CCC2(C)C(=CCC3C2CCC2(C)C(C(C)CCCC(C)C)CCC32)C1]

.

In some embodiments, $R^1$ is an optionally substituted aryl. In some embodiments, $R^1$ is an optionally substituted bicyclic aryl ring.

In some embodiments, $R^1$ is an optionally substituted heteroaryl. In some embodiments, $R^1$ is an optionally substituted 5-6 membered monocyclic heteroaryl ring having 1-3 heteroatoms independently selected from nitrogen, sulfur, or oxygen. In some embodiments, $R^1$ is a substituted 5-6 membered monocyclic heteroaryl ring having 1-3 heteroatoms independently selected from nitrogen, oxygen, or sulfur. In some embodiments, $R^1$ is an unsubstituted 5-6 membered monocyclic heteroaryl ring having 1-3 heteroatoms independently selected from nitrogen, sulfur, or oxygen.

In some embodiments, $R^1$ is an optionally substituted 5 membered monocyclic heteroaryl ring having 1-3 heteroatoms independently selected from nitrogen, oxygen or sulfur. In some embodiments, $R^1$ is an optionally substituted 6 membered monocyclic heteroaryl ring having 1-3 heteroatoms independently selected from nitrogen, oxygen, or sulfur.

In some embodiments, $R^1$ is an optionally substituted 5-membered monocyclic heteroaryl ring having 1 heteroatom selected from nitrogen, oxygen, or sulfur. In some embodiments, $R^1$ is selected from pyrrolyl, furanyl, or thienyl.

In some embodiments, $R^1$ is an optionally substituted 5-membered heteroaryl ring having 2 heteroatoms independently selected from nitrogen, oxygen, or sulfur. In certain embodiments, $R^1$ is an optionally substituted 5-membered heteroaryl ring having 1 nitrogen atom, and an additional heteroatom selected from sulfur or oxygen. Example $R^1$ groups include optionally substituted pyrazolyl, imidazolyl, thiazolyl, isothiazolyl, oxazolyl or isoxazolyl.

In some embodiments, $R^1$ is a 6-membered heteroaryl ring having 1-3 nitrogen atoms. In other embodiments, $R^1$ is an optionally substituted 6-membered heteroaryl ring having 1-2 nitrogen atoms. In some embodiments, $R^1$ is an optionally substituted 6-membered heteroaryl ring having 2 nitrogen atoms. In certain embodiments, $R^1$ is an optionally substituted 6-membered heteroaryl ring having 1 nitrogen. Example $R^1$ groups include optionally substituted pyridinyl, pyrimidinyl, pyrazinyl, pyridazinyl, triazinyl, or tetrazinyl.

In certain embodiments, $R^1$ is an optionally substituted 8-10 membered bicyclic heteroaryl ring having 1-4 heteroatoms independently selected from nitrogen, oxygen, or sulfur. In some embodiments, $R^1$ is an optionally substituted 5,6-fused heteroaryl ring having 1-4 heteroatoms independently selected from nitrogen, oxygen, or sulfur. In other embodiments, $R^1$ is an optionally substituted 5,6-fused heteroaryl ring having 1-2 heteroatoms independently selected from nitrogen, oxygen, or sulfur. In certain embodiments, $R^1$ is an optionally substituted 5,6-fused heteroaryl ring having 1 heteroatom independently selected from nitrogen, oxygen, or sulfur. In some embodiments, $R^1$ is an optionally substituted indolyl. In some embodiments, $R^1$ is an optionally substituted azabicyclo[3.2.1]octanyl. In certain embodiments, $R^1$ is an optionally substituted 5,6-fused heteroaryl ring having 2 heteroatoms independently selected from nitrogen, oxygen, or sulfur. In some embodiments, $R^1$ is an optionally substituted azaindolyl. In some embodiments, $R^1$ is an optionally substituted benzimidazolyl. In some embodiments, $R^1$ is an optionally substituted benzothiazolyl. In some embodiments, $R^1$ is an optionally substituted benzoxazolyl. In some embodiments, $R^1$ is an optionally substituted indazolyl. In certain embodiments, $R^1$ is an optionally substituted 5,6-fused heteroaryl ring having 3 heteroatoms independently selected from nitrogen, oxygen, or sulfur.

In certain embodiments, $R^1$ is an optionally substituted 6,6-fused heteroaryl ring having 1-4 heteroatoms independently selected from nitrogen, oxygen, or sulfur. In some embodiments, $R^1$ is an optionally substituted 6,6-fused heteroaryl ring having 1-2 heteroatoms independently selected from nitrogen, oxygen, or sulfur. In other embodiments, $R^1$ is an optionally substituted 6,6-fused heteroaryl ring having 1 heteroatom independently selected from nitrogen, oxygen, or sulfur. In some embodiments, $R^1$ is an optionally substituted quinolinyl. In some embodiments, $R^1$ is an optionally substituted isoquinolinyl. According to one aspect, $R^1$ is an optionally substituted 6,6-fused heteroaryl ring having 2 heteroatoms independently selected from nitrogen, oxygen, or sulfur. In some embodiments, $R^1$ is a quinazoline or a quinoxaline.

In some embodiments, $R^1$ is an optionally substituted heterocyclyl. In some embodiments, $R^1$ is an optionally substituted 3-7 membered saturated or partially unsaturated heterocyclic ring having 1-2 heteroatoms independently selected from nitrogen, oxygen, or sulfur. In some embodiments, $R^1$ is a substituted 3-7 membered saturated or partially unsaturated heterocyclic ring having 1-2 heteroatoms independently selected from nitrogen, oxygen, or sulfur. In some embodiments, $R^1$ is an unsubstituted 3-7 membered saturated or partially unsaturated heterocyclic ring having 1-2 heteroatoms independently selected from nitrogen, oxygen, or sulfur.

In some embodiments, $R^1$ is an optionally substituted heterocyclyl. In some embodiments, $R^1$ is an optionally substituted 6 membered saturated or partially unsaturated heterocyclic ring having 1-2 heteroatoms independently selected from nitrogen, oxygen, or sulfur. In some embodiments, $R^1$ is an optionally substituted 6 membered partially unsaturated heterocyclic ring having 2 heteroatoms independently selected from nitrogen, oxygen, or sulfur. In some embodiments, $R^1$ is an optionally substituted 6 membered partially unsaturated heterocyclic ring having 2 oxygen atoms.

In certain embodiments, $R^1$ is a 3-7 membered saturated or partially unsaturated heterocyclic ring having 1-2 heteroatoms independently selected from nitrogen, oxygen, or sulfur. In certain embodiments, $R^1$ is oxiranyl, oxetanyl, tetrahydrofuranyl, tetrahydropyranyl, oxepaneyl, aziridineyl, azetidineyl, pyrrolidinyl, piperidinyl, azepanyl, thiiranyl, thietanyl, tetrahydrothiophenyl, tetrahydrothiopyranyl, thiepanyl, dioxolanyl, oxathiolanyl, oxazolidinyl, imidazolidinyl, thiazolidinyl, dithiolanyl, dioxanyl, morpholinyl, oxathianyl, piperazinyl, thiomorpholinyl, dithianyl, dioxepanyl, oxazepanyl, oxathiepanyl, dithiepanyl, diazepanyl, dihydrofuranonyl, tetrahydropyranonyl, oxepanonyl, pyrolidinonyl, piperidinonyl, azepanonyl, dihydrothiophenonyl, tetrahydrothiopyranonyl, thiepanonyl, oxazolidinonyl, oxazinanonyl, oxazepanonyl, dioxolanonyl, dioxanonyl, dioxepanonyl, oxathiolinonyl, oxathianonyl, oxathiepanonyl, thiazolidinonyl, thiazinanonyl, thiazepanonyl, imidazolidinonyl, tetrahydropyrimidinonyl, diazepanonyl, imidazolidinedionyl, oxazolidinedionyl, thiazolidinedionyl, dioxolanedionyl, oxathiolanedionyl, piperazinedionyl, morpholinedionyl, thiomorpholinedionyl, tetrahydropyranyl, tetrahydrofuranyl, morpholinyl, thiomorpholinyl, piperidinyl, piperazinyl, pyrrolidinyl, tetrahydrothiophenyl, or tetrahydrothiopyranyl. In some embodiments, $R^1$ is an optionally substituted 5 membered saturated or partially unsaturated heterocyclic ring having 1-2 heteroatoms independently selected from nitrogen, oxygen, or sulfur.

In certain embodiments, $R^1$ is an optionally substituted 5-6 membered partially unsaturated monocyclic ring having 1-2 heteroatoms independently selected from nitrogen, oxygen, or sulfur. In certain embodiments, $R^1$ is an optionally substituted tetrahydropyridinyl, dihydrothiazolyl, dihydrooxazolyl, or oxazolinyl group.

In some embodiments, $R^1$ is an optionally substituted 8-10 membered bicyclic saturated or partially unsaturated heterocyclic ring having 1-4 heteroatoms independently selected from nitrogen, oxygen, or sulfur. In some embodiments, $R^1$ is an optionally substituted indolinyl. In some embodiments, $R^1$ is an optionally substituted isoindolinyl. In some embodiments, $R^1$ is an optionally substituted 1, 2, 3, 4-tetrahydroquinoline. In some embodiments, $R^1$ is an optionally substituted 1, 2, 3, 4-tetrahydroisoquinoline.

In some embodiments, $R^1$ is an optionally substituted $C_1$-$C_{10}$ aliphatic wherein one or more methylene units are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—, wherein each variable is independently as defined above and described herein. In some embodiments, $R^1$ is an optionally substituted $C_1$-$C_{10}$ aliphatic wherein one or more methylene units are optionally and independently replaced by an optionally-Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —OC(O)—, or —C(O)O—, wherein each R' is independently as defined above and described herein. In some embodiments, $R^1$ is an optionally substituted $C_1$-$C_{10}$ aliphatic wherein one or more methylene units are optionally and independently replaced by an optionally-Cy-, —O—, —S—, —S—S—, —N(R')—, —C(O)—, —OC(O)—, or —C(O)O—, wherein each R' is independently as defined above and described herein.

In some embodiments, $R^1$ is

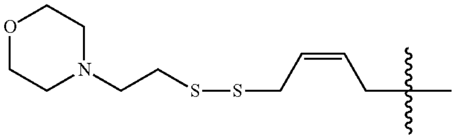

,

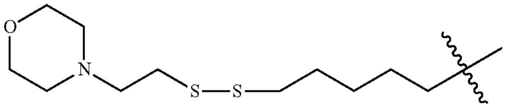

,

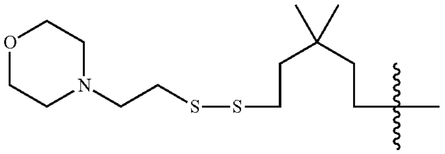

,

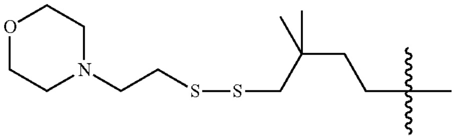

,

-continued

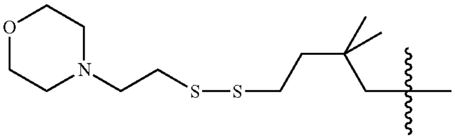

,

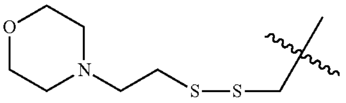

,

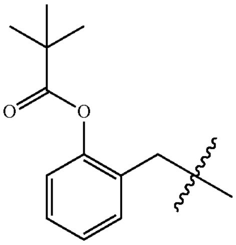

,

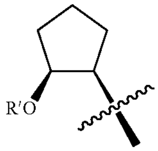

,

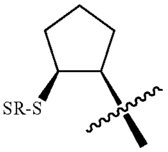

,

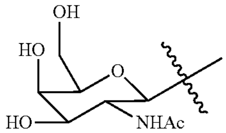

(GalNAc),

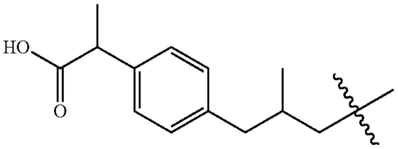

,

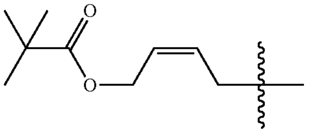

,

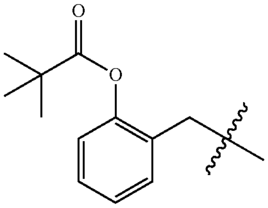

,

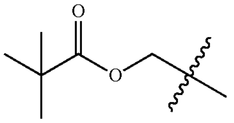

,

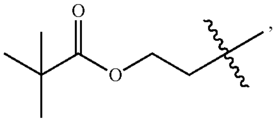

,

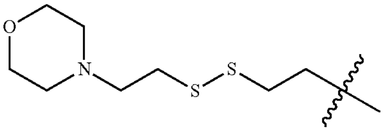

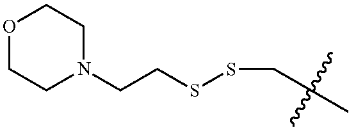

-continued
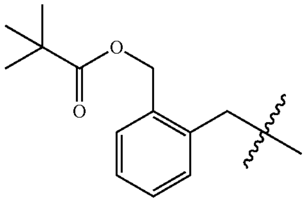
,
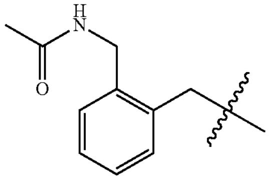
,
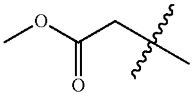
,
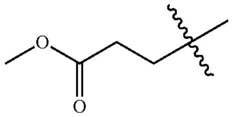
,
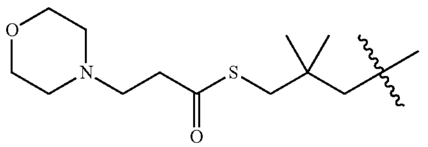
,
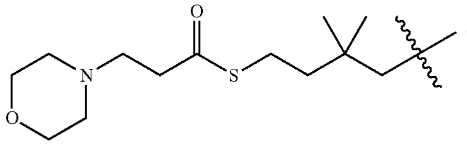
,
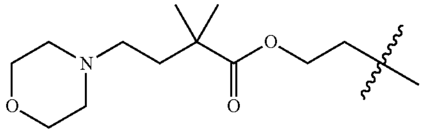
,
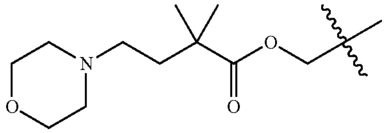
,
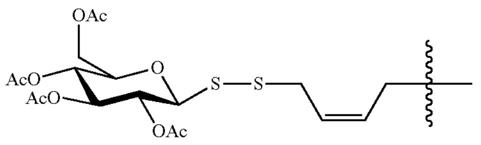
,
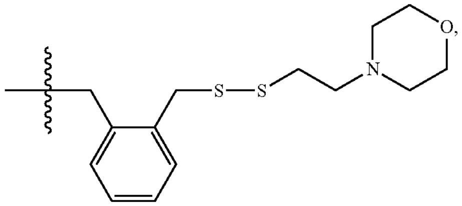
,
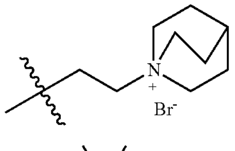
,
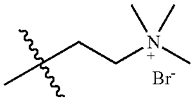
,
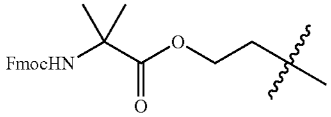
,
-continued
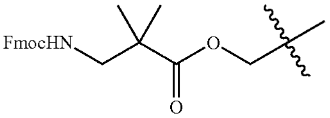
,
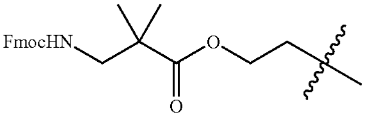
,
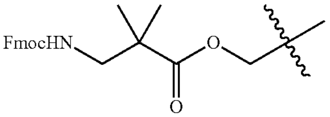
,
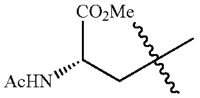
,
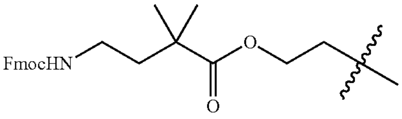
,
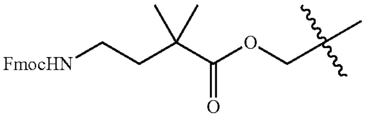
,
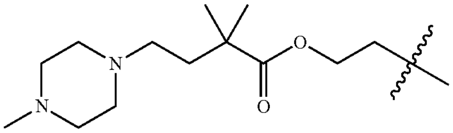
,
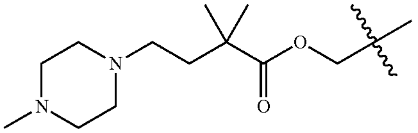
,
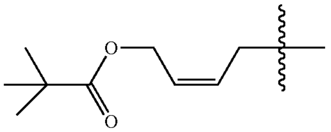
,
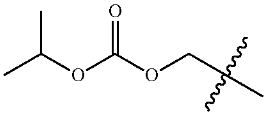
, $CH_3$— ,
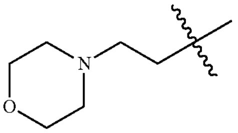
,
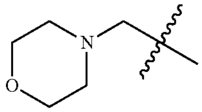
,
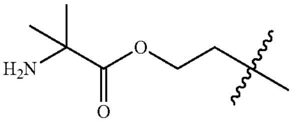
,
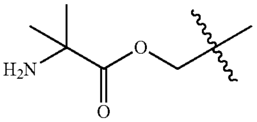
,
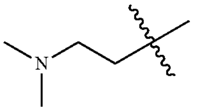
,
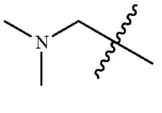
,
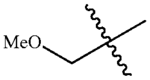
, or -continued

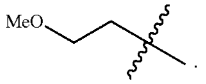

In some embodiments, $R^1$ is $CH_3$—,

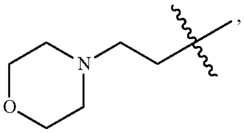

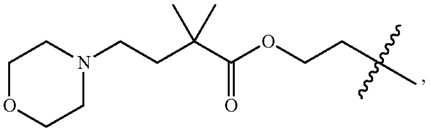

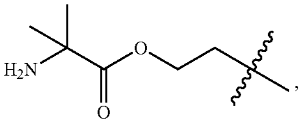

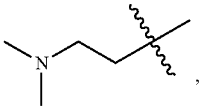

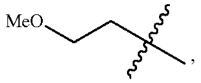

or

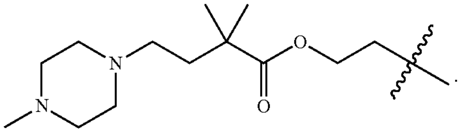

In some embodiments, $R^1$ comprises a terminal optionally substituted —$(CH_2)_2$-moiety which is connected to L. Examples of such $R^1$ groups are depicted below:

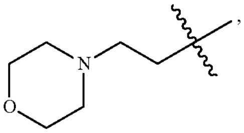

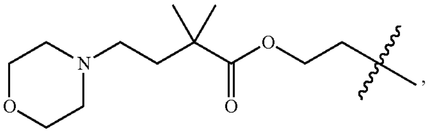

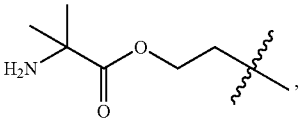

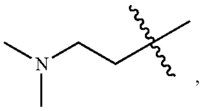

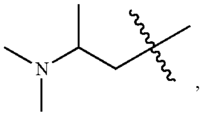

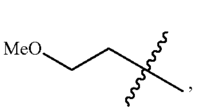

and

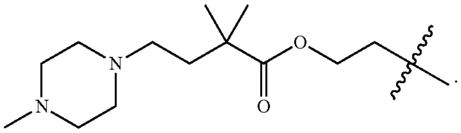

In some embodiments, $R^1$ comprises a terminal optionally substituted —$(CH_2)$-moiety which is connected to L. Example such $R^1$ groups are depicted below:

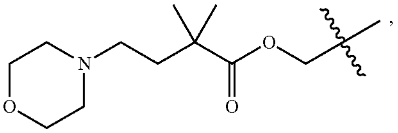

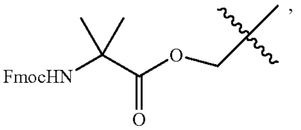

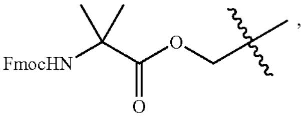

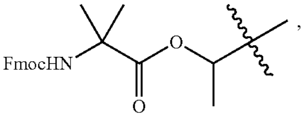

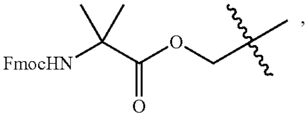

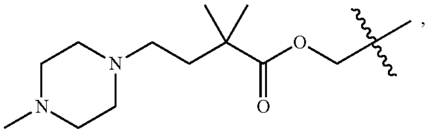

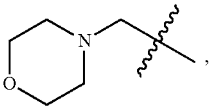

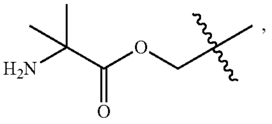

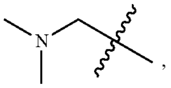

and

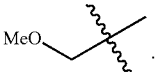

In some embodiments, $R^1$ is —S—$R^{L2}$, wherein $R^{L2}$ is an optionally substituted $C_1$-$C_9$ aliphatic wherein one or more methylene units are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—, and each of R' and -Cy- is independently as defined above and described herein. In some embodiments, $R^1$ is —S—$R^{L2}$, wherein the sulfur atom is connected with the sulfur atom in L group.

In some embodiments, $R^1$ is —C(O)—$R^{L2}$, wherein $R^{L2}$ is an optionally substituted $C_1$-$C_9$ aliphatic wherein one or more methylene units are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—, and each of R' and -Cy- is independently as defined above and described herein. In some embodiments, $R^1$ is —C(O)—$R^{L2}$, wherein the carbonyl group is connected with G in L group. In some embodiments, $R^1$ is —C(O)—$R^{L2}$, wherein the carbonyl group is connected with the sulfur atom in L group.

In some embodiments, $R^{L2}$ is optionally substituted $C_1$-$C_9$ aliphatic. In some embodiments, $R^{L2}$ is optionally substituted $C_1$-$C_9$ alkyl. In some embodiments, $R^{L2}$ is optionally substituted $C_1$-$C_9$ alkenyl. In some embodiments, $R^{L2}$ is optionally substituted $C_1$-$C_9$ alkynyl. In some embodiments, $R^{L2}$ is an optionally substituted $C_1$-$C_9$ aliphatic wherein one or more methylene units are optionally and independently replaced by -Cy- or —C(O)—. In some embodiments, $R^{L2}$ is an optionally substituted $C_1$-$C_9$ aliphatic wherein one or more methylene units are optionally and independently replaced by -Cy-. In some embodiments, $R^{L2}$ is an optionally substituted $C_1$-$C_9$ aliphatic wherein one or more methylene units are optionally and independently replaced by an optionally substituted heterocyclylene. In some embodiments, $R^{L2}$ is an optionally substituted $C_1$-$C_9$ aliphatic wherein one or more methylene units are optionally and independently replaced by an optionally substituted arylene. In some embodiments, $R^{L2}$ is an optionally substituted $C_1$-$C_9$ aliphatic wherein one or more methylene units are optionally and independently replaced by an optionally substituted heteroarylene. In some embodiments, $R^{L2}$ is an optionally substituted $C_1$-$C_9$ aliphatic wherein one or more methylene units are optionally and independently replaced by an optionally substituted $C_3$-$C_{10}$ carbocyclylene. In some embodiments, $R^{L2}$ is an optionally substituted $C_1$-$C_9$ aliphatic wherein two methylene units are optionally and independently replaced by -Cy- or —C(O)—. In some embodiments, $R^{L2}$ is an optionally substituted $C_1$-$C_9$ aliphatic wherein two methylene units are optionally and independently replaced by -Cy- or —C(O)—. Example $R^{L2}$ groups are depicted below:

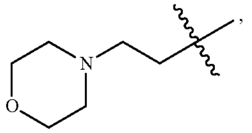

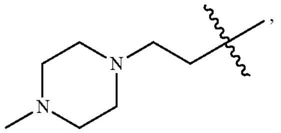

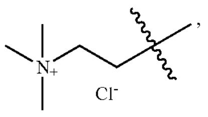

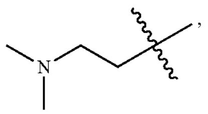

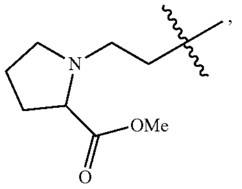

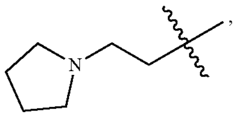

and

-continued

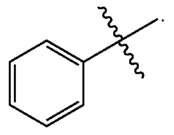

In some embodiments, $R^1$ is hydrogen, or an optionally substituted group selected from

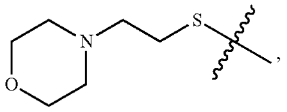

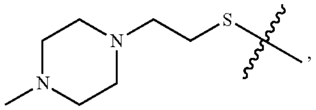

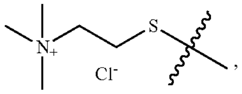

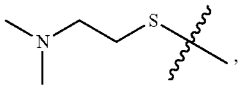

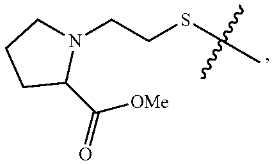

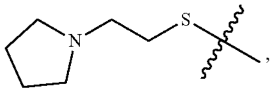

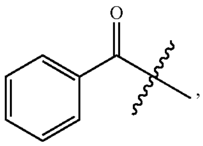

—S—($C_1$-$C_{10}$ aliphatic), $C_1$-$C_{10}$ aliphatic, aryl, $C_1$-$C_6$ heteroalkyl, heteroaryl and heterocyclyl. In some embodiments, $R^1$ is

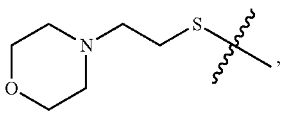

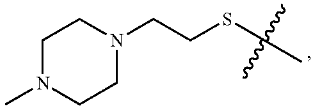

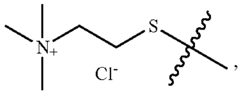

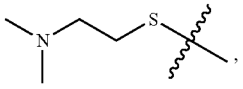

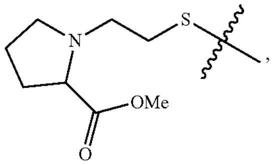

-continued

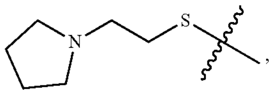

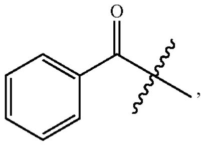

or —S—($C_1$-$C_{10}$ aliphatic). In some embodiments, R is

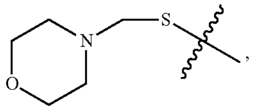

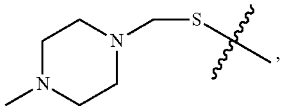

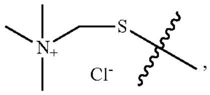

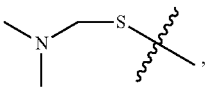

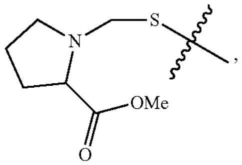

or

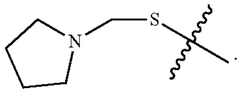

In some embodiments, $R^1$ is an optionally substituted group selected from —S—($C_1$-$C_6$ aliphatic), $C_1$-$C_{10}$ aliphatic, $C_1$-$C_6$ heteroaliphatic, aryl, heterocyclyl and heteroaryl.

In some embodiments, $R^1$ is

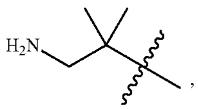

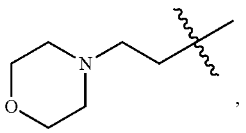

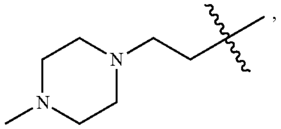

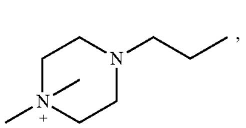

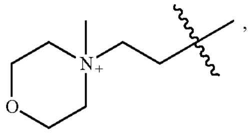

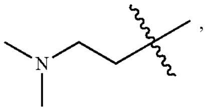

-continued

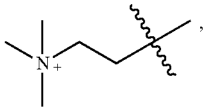

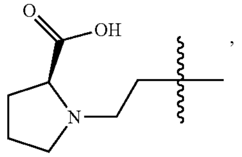

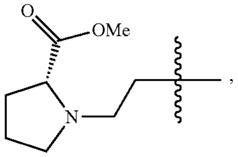

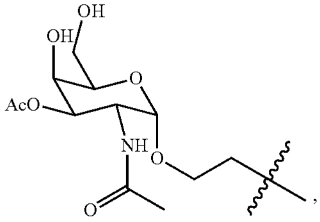

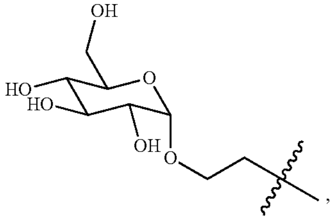

or

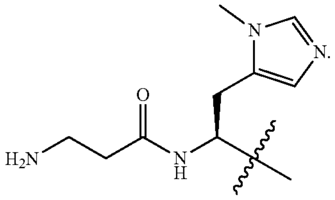

In some embodiments, the sulfur atom in the $R^1$ embodiments described above and herein is connected with the sulfur atom, G, E, or —C(O)— moiety in the L embodiments described above and herein. In some embodiments, the —C(O)— moiety in the $R^1$ embodiments described above and herein is connected with the sulfur atom, G, E, or —C(O)— moiety in the L embodiments described above and herein.

In some embodiments, -L-$R^1$ is any combination of the L embodiments and $R^1$ embodiments described above and herein.

In some embodiments, -L-$R^1$ is -$L^3$-G-$R^1$ wherein each variable is independently as defined above and described herein.

In some embodiments, -L-$R^1$ is -$L^4$-G-$R^1$ wherein each variable is independently as defined above and described herein.

In some embodiments, -L-$R^1$ is -$L^3$-G-S—$R^{L2}$, wherein each variable is independently as defined above and described herein.

In some embodiments, -L-$R^1$ is -$L^3$-G-C(O)—$R^{L2}$, wherein each variable is independently as defined above and described herein.

In some embodiments, -L-$R^1$ is

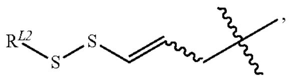,

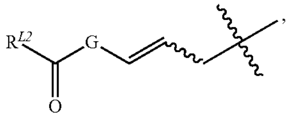,

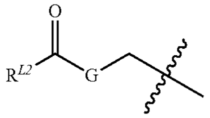, or

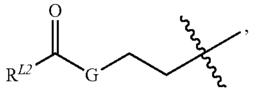, wherein is an optionally substituted $C_1$-$C_9$ aliphatic wherein one or more methylene units are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—, and each G is independently as defined above and described herein.

In some embodiments, -L-$R^1$ is —$R^{L3}$—S—S—$R^{L2}$, wherein each variable is independently as defined above and described herein. In some embodiments, -L-$R^1$ is —$R^{L3}$—C(O)—S—S—$R^{L2}$, wherein each variable is independently as defined above and described herein.

In some embodiments, -L-$R^1$ has the structure of:

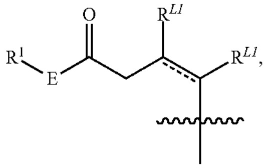

wherein each variable is independently as defined above and described herein.

In some embodiments, -L-$R^1$ has the structure of:

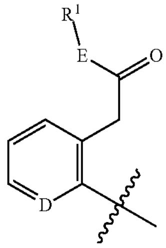, wherein each variable is independently as defined above and described herein.

In some embodiments, -L-$R^1$ has the structure of:

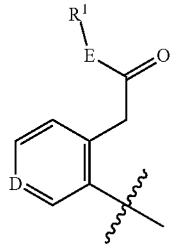, wherein each variable is independently as defined above and described herein.

In some embodiments, -L-$R^1$ has the structure of:

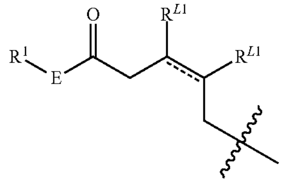, wherein each variable is independently as defined above and described herein.

In some embodiments, -L-$R^1$ has the structure of:

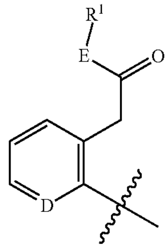, wherein each variable is independently as defined above and described herein.

In some embodiments, -L-$R^1$ has the structure of:

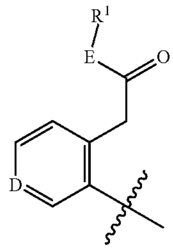, wherein each variable is independently as defined above and described herein.

In some embodiments, -L-$R^1$ has the structure of:

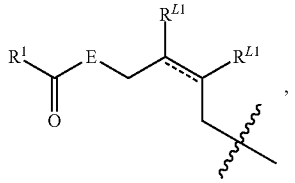

wherein each variable is independently as defined above and described herein.

In some embodiments, -L-$R^1$ has the structure of:

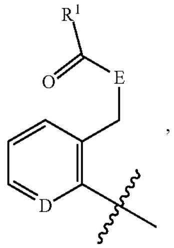

wherein each variable is independently as defined above and described herein.

In some embodiments, -L-$R^1$ has the structure of:

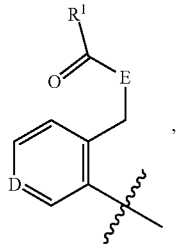

wherein each variable is independently as defined above and described herein.

In some embodiments, -L-$R^1$ has the structure of:

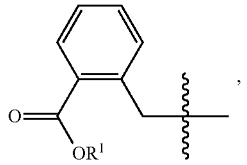

wherein each variable is independently as defined above and described herein.

In some embodiments, -L-$R^1$ has the structure of:

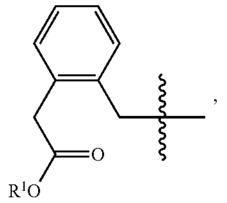

wherein each variable is independently as defined above and described herein.

In some embodiments, -L-$R^1$ has the structure of:

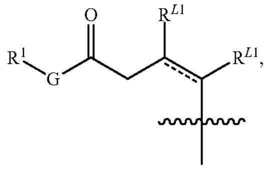

wherein each variable is independently as defined above and described herein.

In some embodiments, -L-$R^1$ has the structure of:

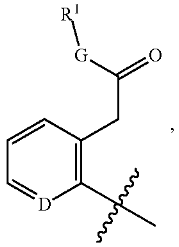

wherein each variable is independently as defined above and described herein.

In some embodiments, -L-$R^1$ has the structure of:

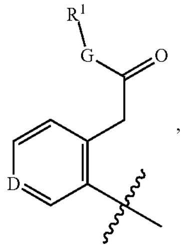

wherein each variable is independently as defined above and described herein.

In some embodiments, -L-$R^1$ has the structure of:

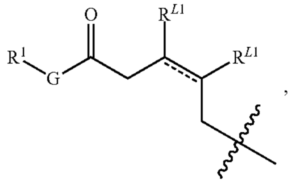

wherein each variable is independently as defined above and described herein.

In some embodiments, -L-$R^1$ has the structure of:

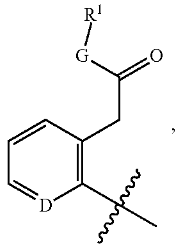

wherein each variable is independently as defined above and described herein.

In some embodiments, -L-$R^1$ has the structure of:

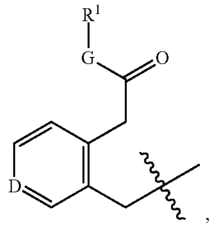

wherein each variable is independently as defined above and described herein.

In some embodiments, -L-$R^1$ has the structure of:

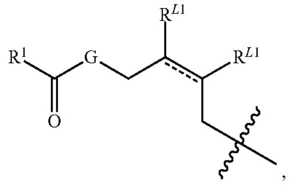

wherein each variable is independently as defined above and described herein.

In some embodiments, -L-$R^1$ has the structure of:

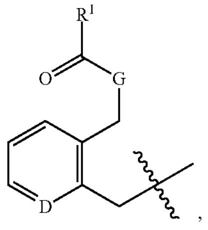

wherein each variable is independently as defined above and described herein.

In some embodiments, -L-$R^1$ has the structure of:

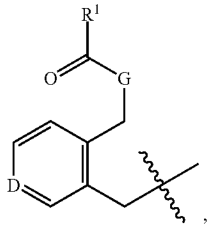

wherein each variable is independently as defined above and described herein.

In some embodiments, -L-$R^1$ has the structure of:

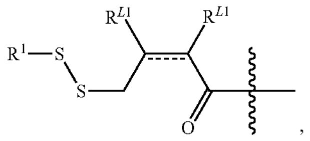

wherein each variable is independently as defined above and described herein.

In some embodiments, L has the structure of:

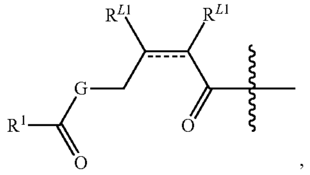

wherein each variable is independently as defined above and described herein.

In some embodiments, —X-L-$R^1$ has the structure of:

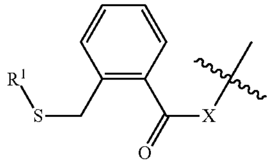

wherein:

the phenyl ring is optionally substituted, and each of $R^1$ and X is independently as defined above and described herein.

In some embodiments, -L-$R^1$ is

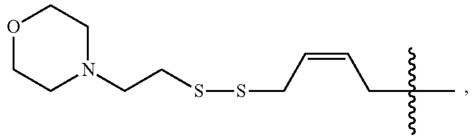

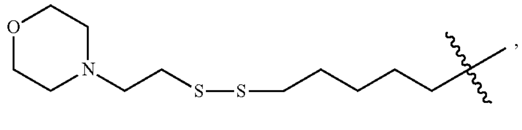

-continued
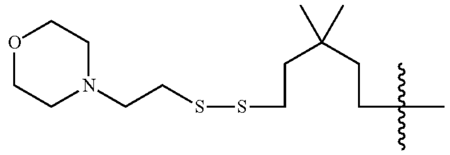 ,
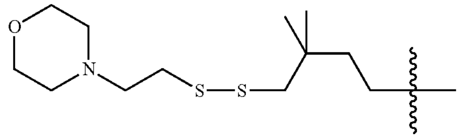 ,
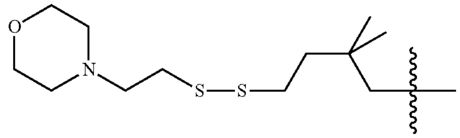 ,
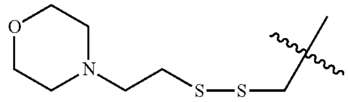 ,
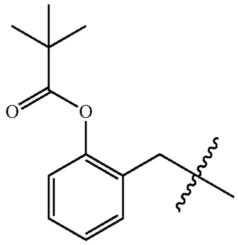 , 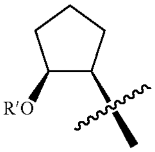 ,
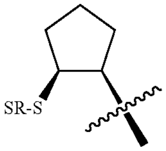 , 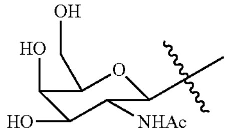 (GalNAc),
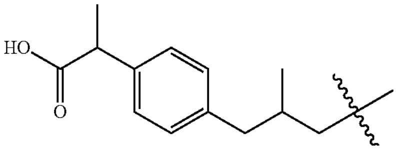 ,
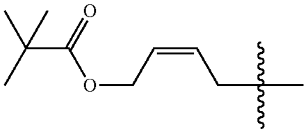 ,
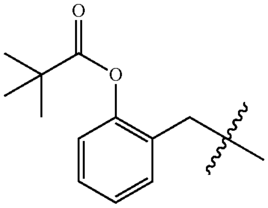 ,
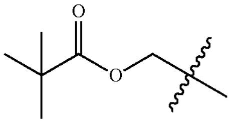 ,
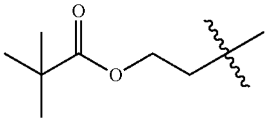 ,
-continued
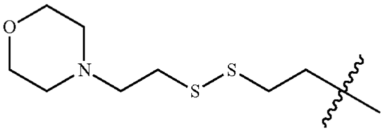
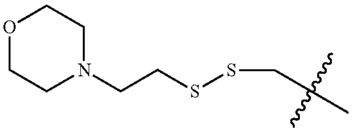
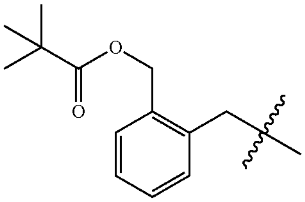 ,
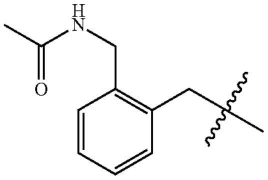 , 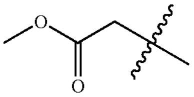 ,
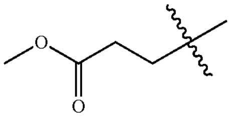 ,
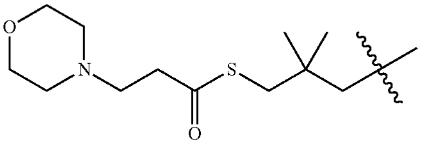 ,
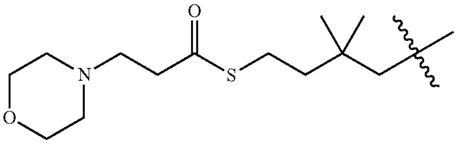 ,
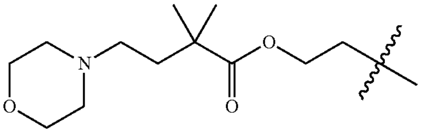 ,
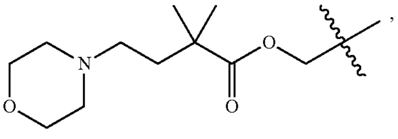 ,
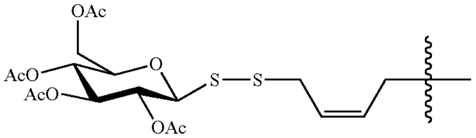 ,
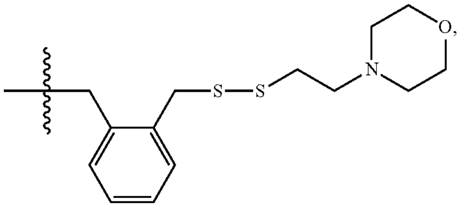

-continued
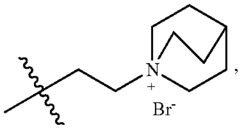, 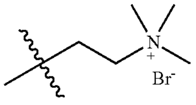,
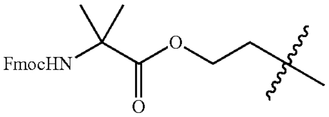,
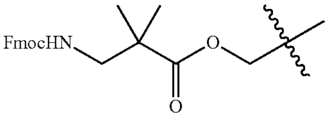,
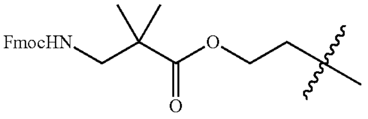,
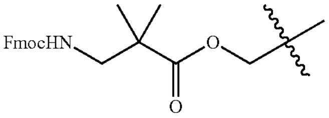,
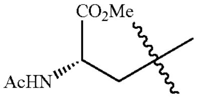,
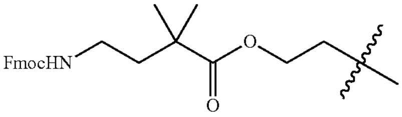,
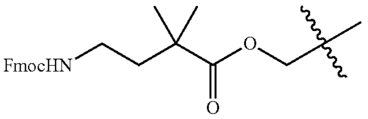,
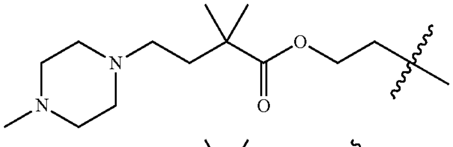,
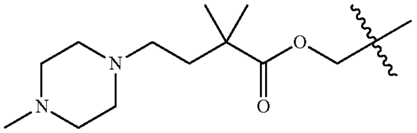,
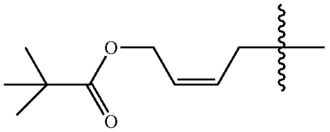,
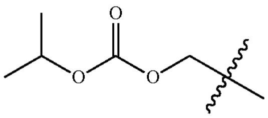, $CH_3$—,
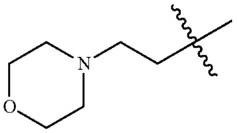, 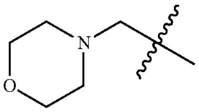,
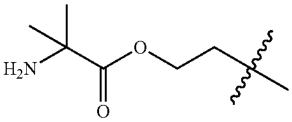,
-continued
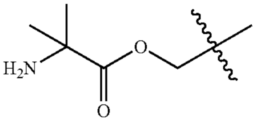, 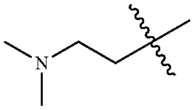,
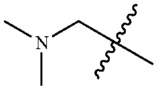, 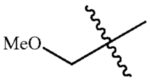, or
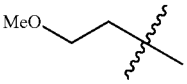.
In some embodiments, -L-$R^1$ is:
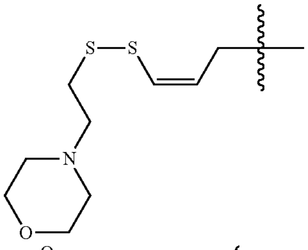,
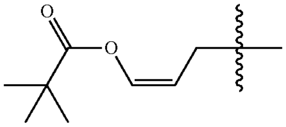, or
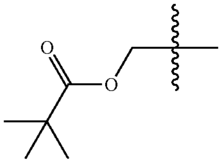.
In some embodiments, -L-$R^1$ is $CH_3$—,
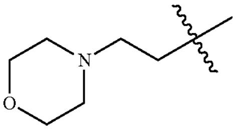,
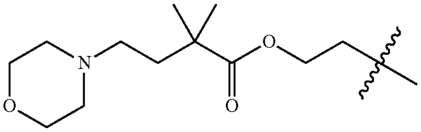,
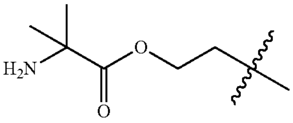, 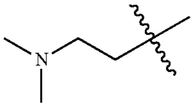,
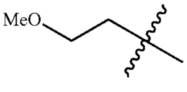, or
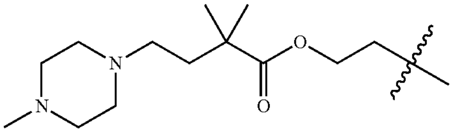.

In some embodiments, -L-$R^1$ is

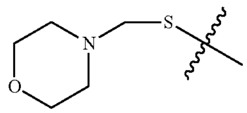

,

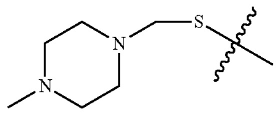

,

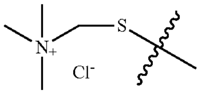

,

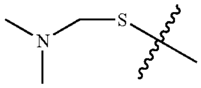

,

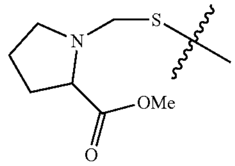

, or

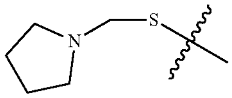

.

In some embodiments, -L-$R^1$ comprises a terminal optionally substituted —$(CH_2)_2$— moiety which is connected to X. In some embodiments, -L-$R^1$ comprises a terminal —$(CH_2)_2$— moiety which is connected to X. Examples of such -L-$R^1$ moieties are depicted below:

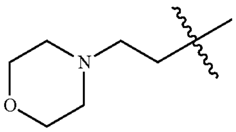

,

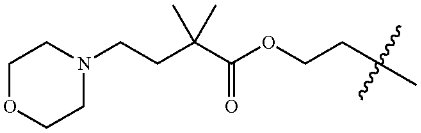

,

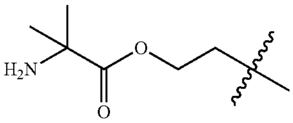

,

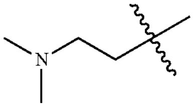

,

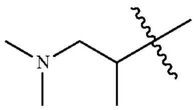

,

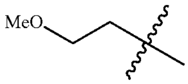

, and

-continued

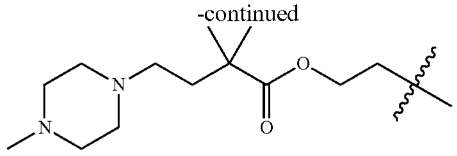

.

In some embodiments, -L-$R^1$ comprises a terminal optionally substituted —$(CH_2)$— moiety which is connected to X. In some embodiments, -L-$R^1$ comprises a terminal —$(CH_2)$— moiety which is connected to X. Examples of such -L-$R^1$ moieties are depicted below:

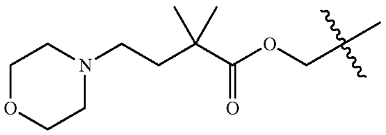

,

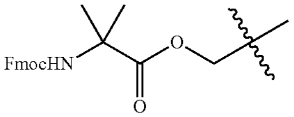

,

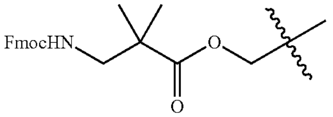

,

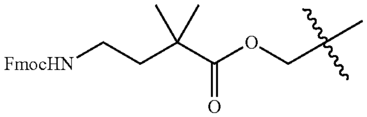

,

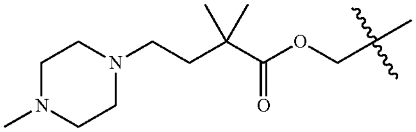

,

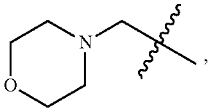

,

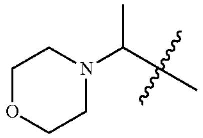

,

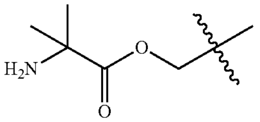

,

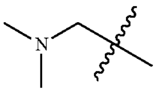

, and

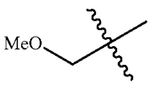

.

In some embodiments, -L-$R^1$ is

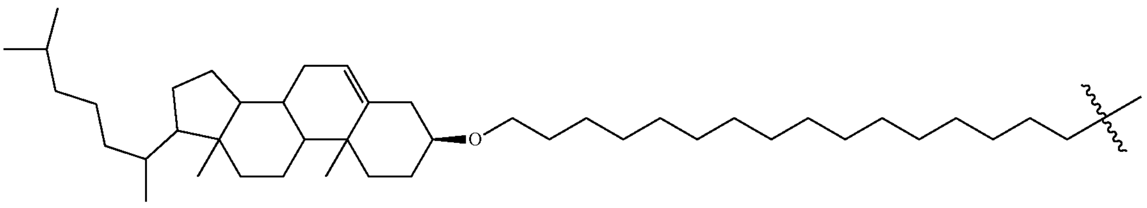

,

-continued
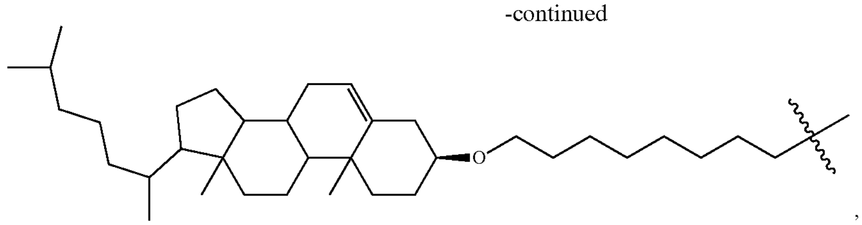
, or
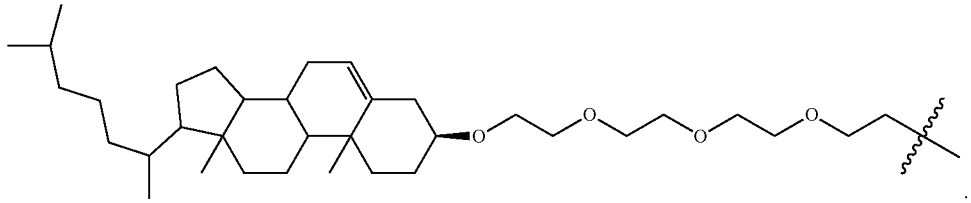
.
In some embodiments -L-$R^1$ is $CH_3$—,
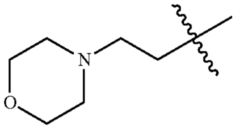
,
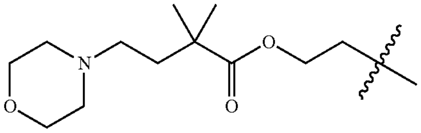
,
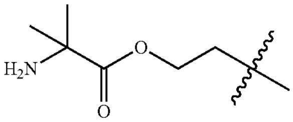
,
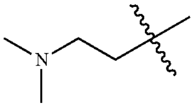
,
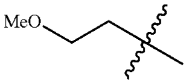
,
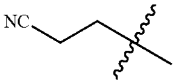
, or
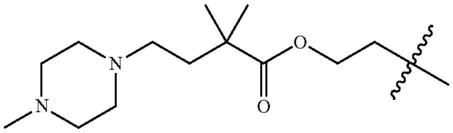
;
and X is —S—.
In some embodiments, -L-$R^1$ is $CH_3$—,
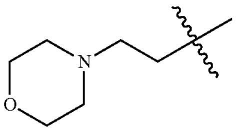
,
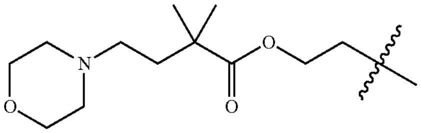
,
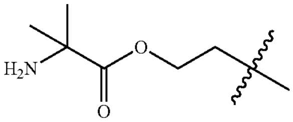
,
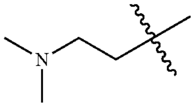
,
-continued
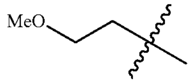
, or
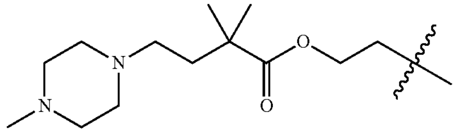
,
X is —S—, W is O, Y is —O—, and Z is —O—.
In some embodiments, $R^1$ is
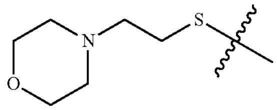
,
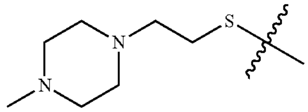
,
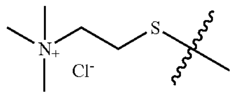
,
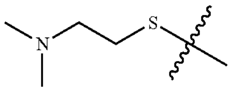
,
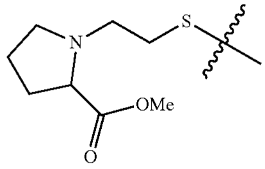
,
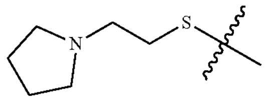
,
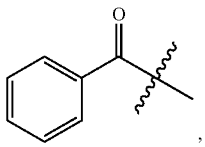
,
or —S—($C_1$-$C_{10}$ aliphatic).

In some embodiments, $R^1$ is
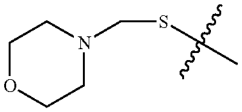,
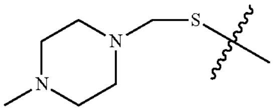, 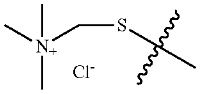,
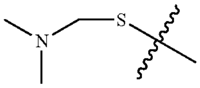, 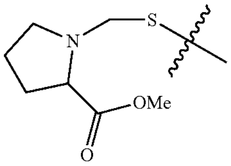, or
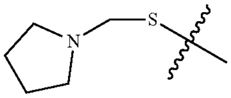.
In some embodiments, X is —O— or —S—, and $R^1$ is
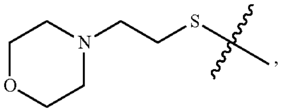,
-continued
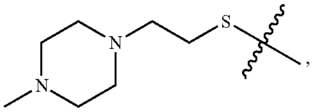,
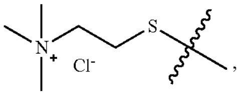, 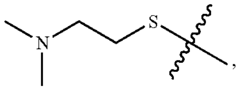,
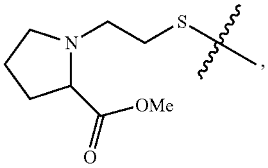,
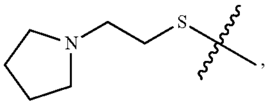, 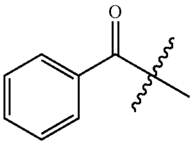,
or —S—($C_1$-$C_{10}$ aliphatic).
In some embodiments, X is —O— or —S—, and $R^1$ is
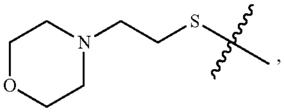, 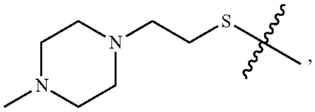, 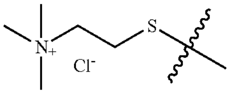, 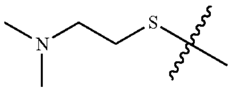,
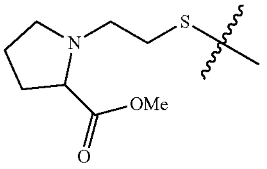, 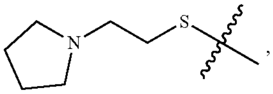, 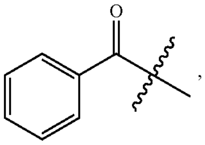,
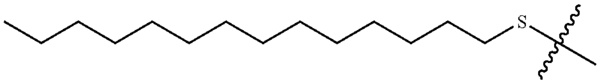,
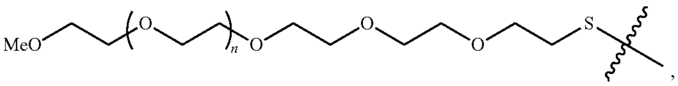,
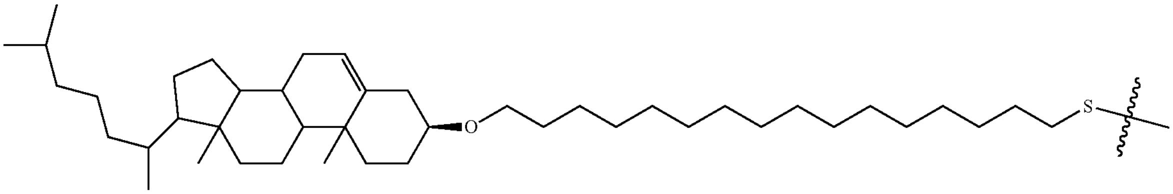,
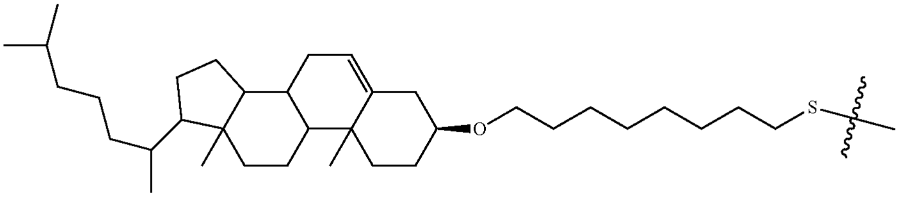, -continued
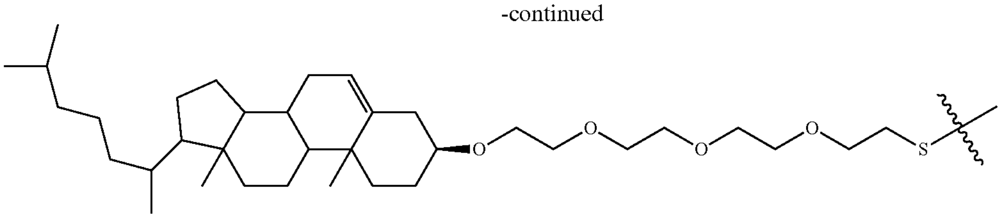
,
—S—($C_1$-$C_{10}$ aliphatic) or —S—($C_1$-$C_{50}$ aliphatic).
In some embodiments, L is a covalent bond and -L-$R^1$ is $R^1$.
In some embodiments, -L-$R^1$ is not hydrogen.
In some embodiments, —X-L-$R^1$ is $R^1$ is
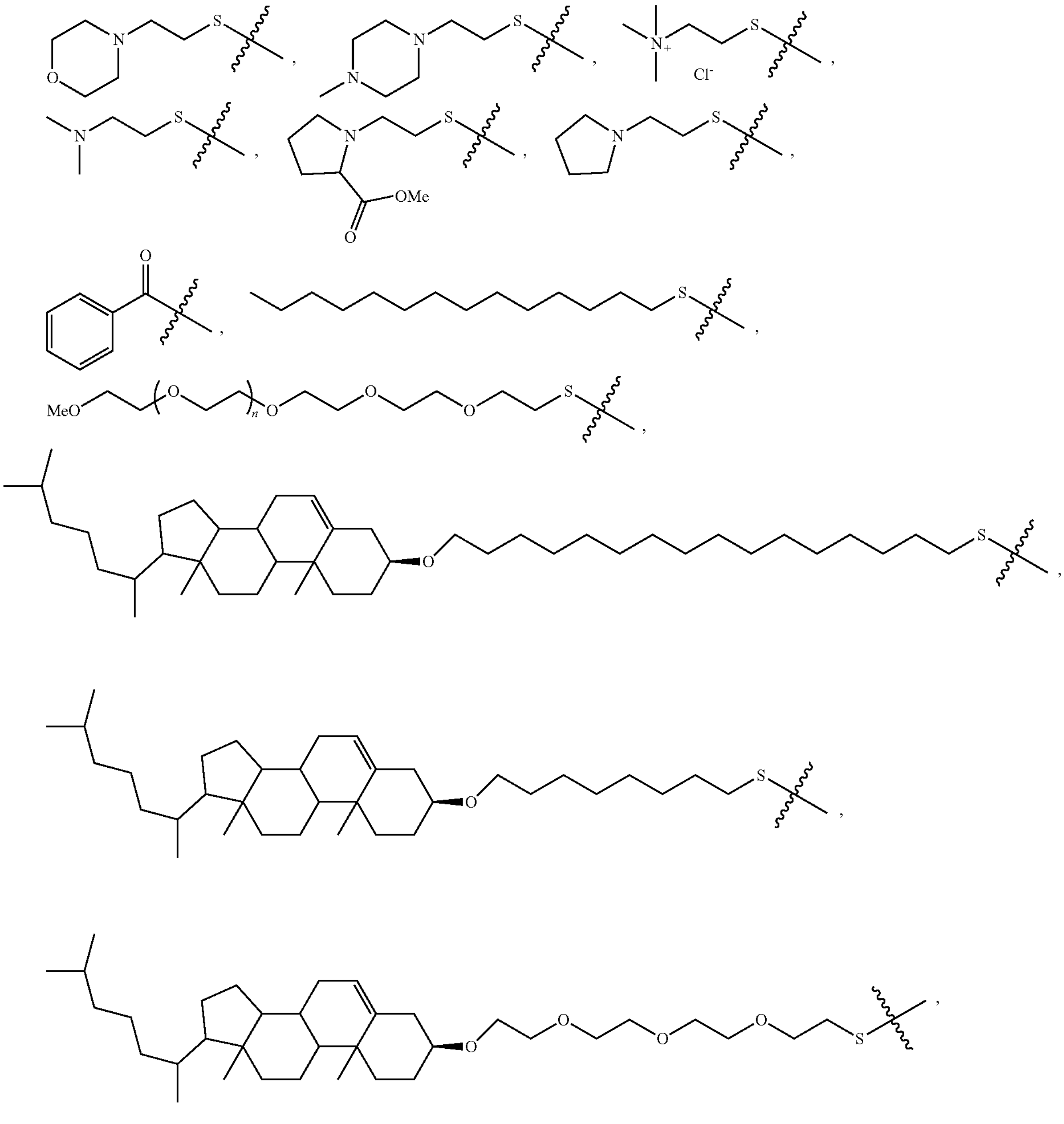
—S—($C_1$-$C_{10}$ aliphatic) or —S—($C_1$-$C_{50}$ aliphatic).

In some embodiments, —X-L-$R^1$ has the structure of

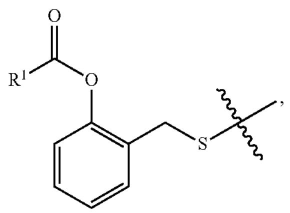

wherein the

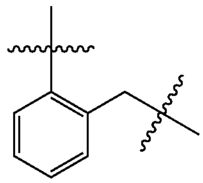 [SMILES: *Cc1ccccc1*]

moiety is optionally substituted. In some embodiments, —X-L-$R^1$ is

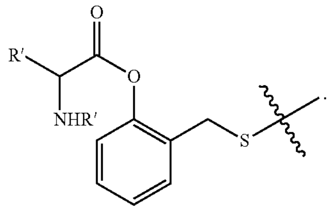

In some embodiments, —X-L-$R^1$ is

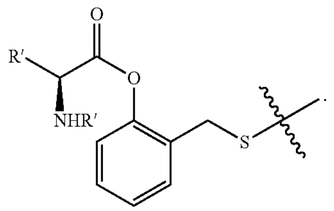

In some embodiments, —X-L-$R^1$ is

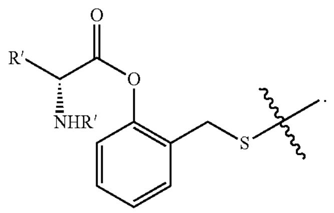

In some embodiments, —X-L-$R^1$ has the structure of

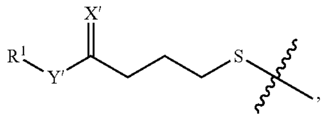

wherein X' is O or S, Y' is —O—, —S— or —NR'—, and the

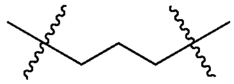 [SMILES: *CCC*]

moiety is optionally substituted. In some embodiments, Y' is —O—, —S— or —NH—. In some embodiments,

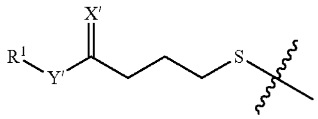

is

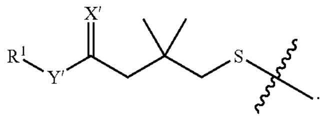

In some embodiments,

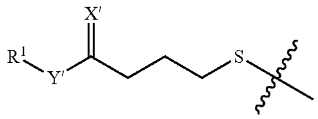

is

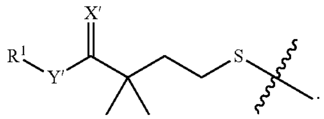

In some embodiments,

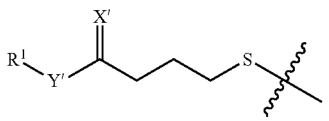

is

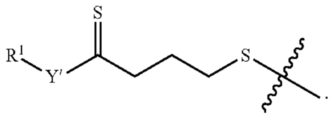

In some embodiments, —X-L-$R^1$ has the structure of

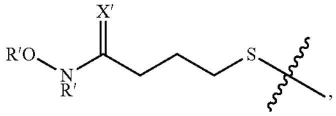

wherein X' is O or S, and the

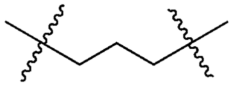 [SMILES: *CCC*]

moiety is optionally substituted. In some embodiments,

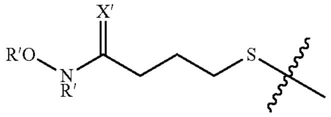

is

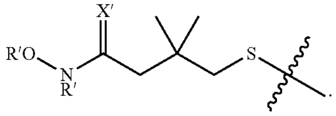

In some embodiments, —X-L-$R^1$ is

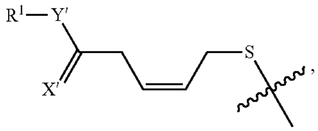

wherein the

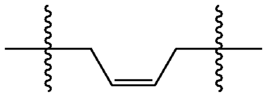

is optionally substituted. In some embodiments, —X-L-$R^1$ is

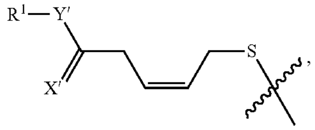

wherein the

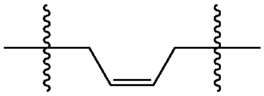 [SMILES: *C/C=C\C*]

is substituted. In some embodiments, —X-L-$R^1$ is

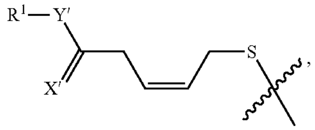

wherein the

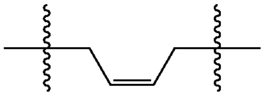

is unsubstituted.

In some embodiments, —X-L-$R^1$ is $R^1$—C(O)—S-$L^x$-S—, wherein $L^x$ is an optionally substituted group selected from

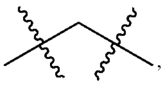

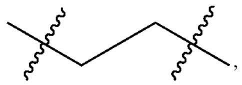

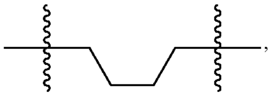

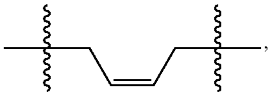

and

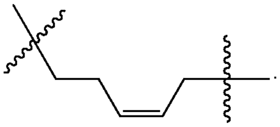

In some embodiments, $L^x$ is

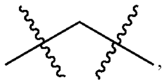,
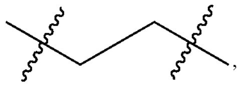,
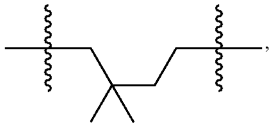,
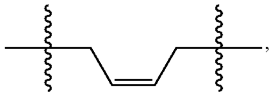, and
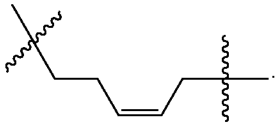.

In some embodiments, $—X-L-R^1$ is $(CH_3)_3C—S—S-L^x-S—$. In some embodiments, $—X-L-R^1$ is $R^1—C(=X')—Y'—C(R)_2—S-L^x-S—$. In some embodiments, $—X-L-R^1$ is $R—C(=X')—Y—CH_2—S-L^x-S—$. In some embodiments, $—X-L-R^1$ is

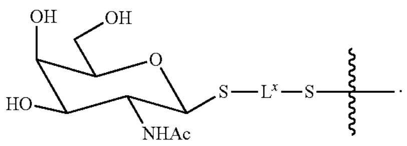

As will be appreciated by a person skilled in the art, many of the $—X-L-R^1$ groups described herein are cleavable and can be converted to —X— after administration to a subject. In some embodiments, $—X-L-R^1$ is cleavable. In some embodiments, $—X-L-R^1$ is $—S-L-R^1$, and is converted to —S— after administration to a subject. In some embodiments, the conversion is promoted by an enzyme of a subject. As appreciated by a person skilled in the art, methods of determining whether the $—S-L-R^1$ group is converted to —S— after administration is widely known and practiced in the art, including those used for studying drug metabolism and pharmacokinetics.

In some embodiments, the internucleotidic linkage having the structure of formula I is

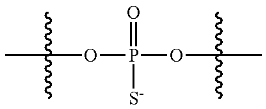,

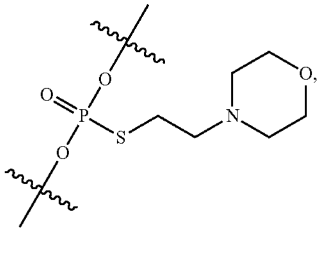

-continued

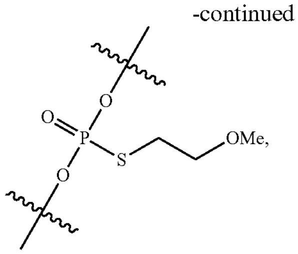

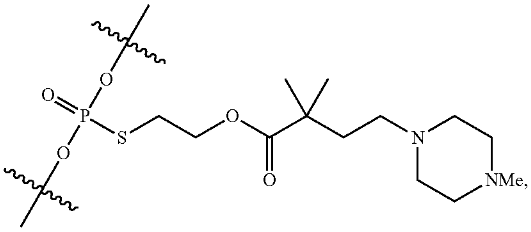

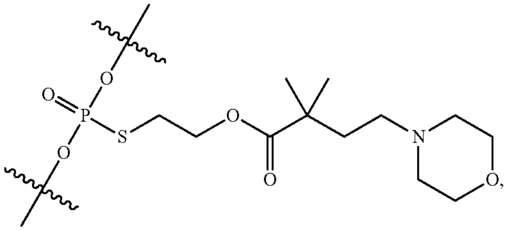

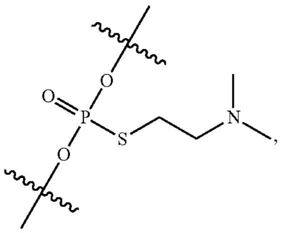

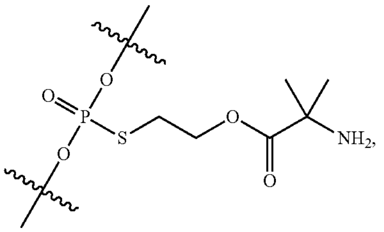 or

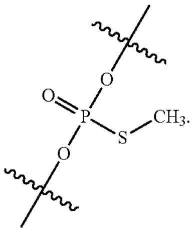

In some embodiments, the internucleotidic linkage of formula I has the structure of formula I-a:

(I-a)

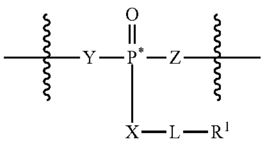

wherein each variable is independently as defined above and described herein.

In some embodiments, the internucleotidic linkage of formula I has the structure of formula I-b:

(I-b)

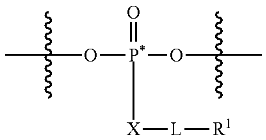

wherein each variable is independently as defined above and described herein.

In some embodiments, the internucleotidic linkage of formula I is an phosphorothioate triester linkage having the structure of formula I-c:

(I-c)

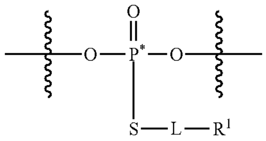

wherein:

P* is an asymmetric phosphorus atom and is either Rp or Sp;

L is a covalent bond or an optionally substituted, linear or branched $C_1$-$C_{10}$ alkylene, wherein one or more methylene units of L are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—;

$R^1$ is halogen, R, or an optionally substituted $C_1$-$C_{50}$ aliphatic wherein one or more methylene units are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—;

each R' is independently —R, —C(O)R, —$CO_2$R, or —$SO_2$R, or:

two R' on the same nitrogen are taken together with their intervening atoms to form an optionally substituted heterocyclic or heteroaryl ring, or two R' on the same carbon are taken together with their intervening atoms to form an optionally substituted aryl, carbocyclic, heterocyclic, or heteroaryl ring;

-Cy- is an optionally substituted bivalent ring selected from phenylene, carbocyclylene, arylene, heteroarylene, or heterocyclylene;

each R is independently hydrogen, or an optionally substituted group selected from $C_1$-$C_6$ aliphatic, phenyl, carbocyclyl, aryl, heteroaryl, or heterocyclyl;

each

independently represents a connection to a nucleoside; and $R^1$ is not —H when L is a covalent bond.

In some embodiments, the internucleotidic linkage having the structure of formula I is

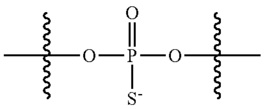

,

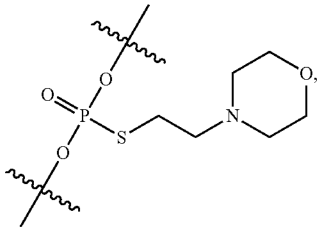

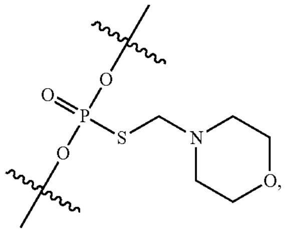

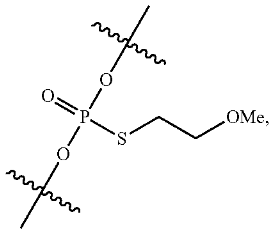

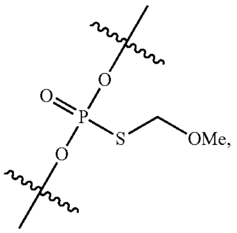

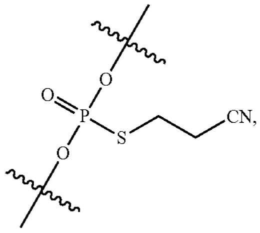

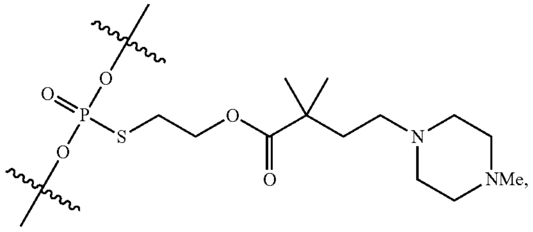

-continued
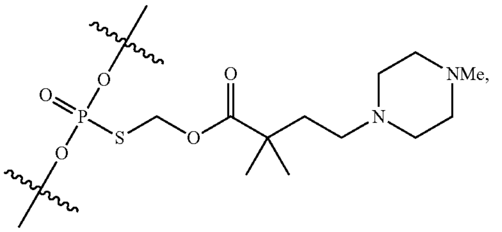
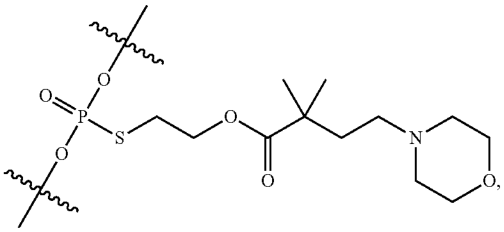
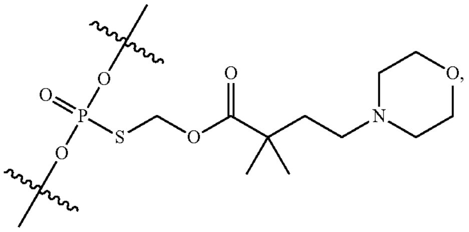
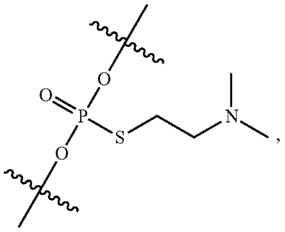
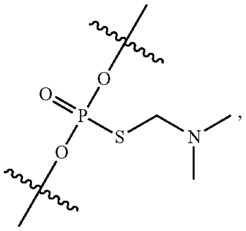
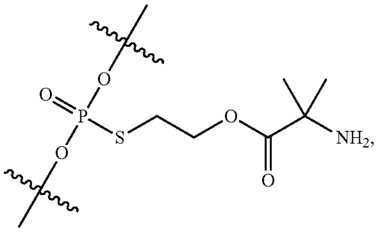
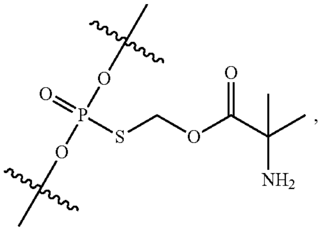
or
-continued
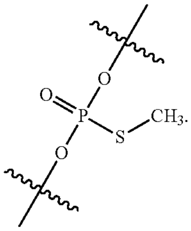
In some embodiments, the internucleotidic linkage having the structure of formula I-c is
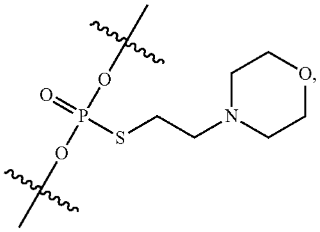
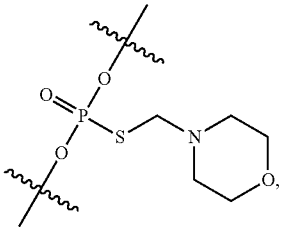
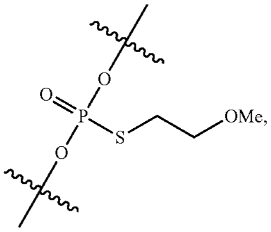
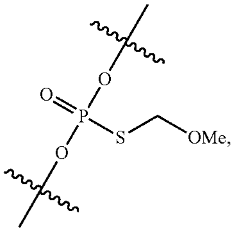
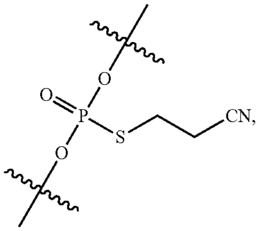
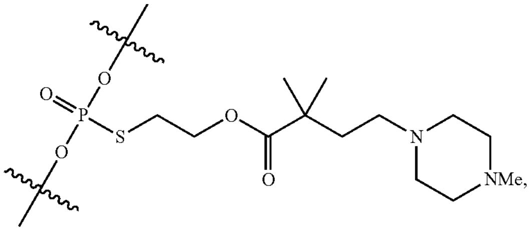

-continued

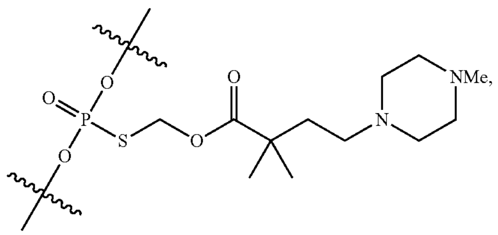

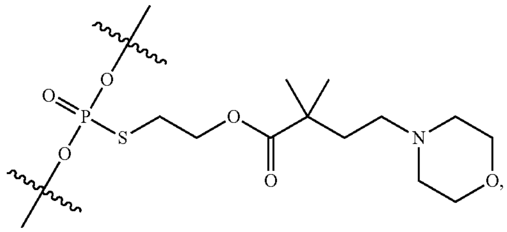

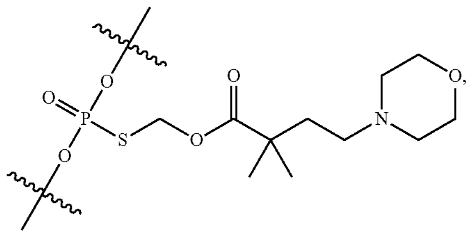

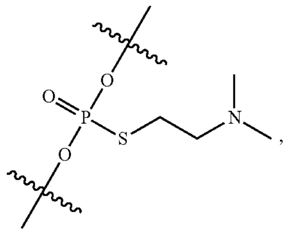

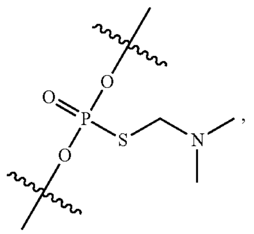

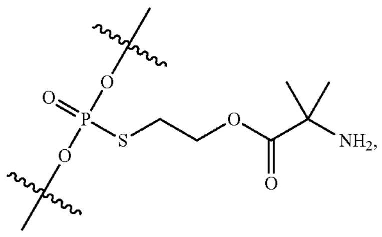

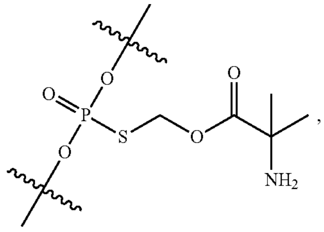

or

-continued

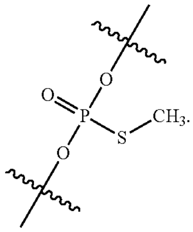

In some embodiments, the present disclosure provides a chirally controlled oligonucleotide comprising one or more phosphate diester linkages, and one or more modified internucleotide linkages having the formula of I-a, I-b, or I-c.

In some embodiments, a modified internucleotidic linkage has the structure of I. In some embodiments, a modified internucleotidic linkage has the structure of I-a. In some embodiments, a modified internucleotidic linkage has the structure of I-b. In some embodiments, a modified internucleotidic linkage has the structure of I-c.

In some embodiments, a modified internucleotidic linkage is phosphorothioate. Examples of internucleotidic linkages having the structure of formula I are widely known in the art, including but not limited to those described in US 20110294124, US 20120316224, US 20140194610, US 20150211006, US 20150197540, WO 2015107425, PCT/US2016/043542, and PCT/US2016/043598, each of which is incorporated herein by reference.

Non-limiting examples of internucleotidic linkages also include those described in the art, including, but not limited to, those described in any of: Gryaznov, S.; Chen, J.-K. J. Am. Chem. Soc. 1994, 116, 3143, Jones et al. J. Org. Chem. 1993, 58, 2983, Koshkin et al. 1998 Tetrahedron 54: 3607-3630, Lauritsen et al. 2002 Chem. Comm. 5: 530-531, Lauritsen et al. 2003 Bioo. Med. Chem. Lett. 13: 253-256, Mesmaeker et al. Angew. Chem., Int. Ed. Engl. 1994, 33, 226, Petersen et al. 2003 TRENDS Biotech. 21: 74-81, Schultz et al. 1996 Nucleic Acids Res. 24: 2966, Ts'o et al. Ann. N. Y. Acad. Sci. 1988, 507, 220, and Vasseur et al. J. Am. Chem. Soc. 1992, 114, 4006.

Oligonucleotides of the provided technologies can be of various lengths. In some embodiments, provided oligonucleotides comprise 5, 6, 7, 8, 9, 10, 11, 12, 13, 14, 15, 16, 17, 18, 19, 20, 21, 22, 23, 24, 25, 26, 27, 28, 29, 30, 40, 50 or more bases. In some embodiments, provided oligonucleotides comprise 10, 11, 12, 13, 14, 15, 16, 17, 18, 19, 20, 21, 22, 23, 24, 25, 26, 27, 28, 29, 30, 40, 50 or more bases. In some embodiments, provided oligonucleotides comprise 15, 16, 17, 18, 19, 20, 21, 22, 23, 24, 25, 26, 27, 28, 29, 30, 40, 50 or more bases. In some embodiments, provided oligonucleotides comprise 15 or more bases. In some embodiments, provided oligonucleotides comprise 16 or more bases. In some embodiments, provided oligonucleotides comprise 17 or more bases. In some embodiments, provided oligonucleotides comprise 18 or more bases. In some embodiments, provided oligonucleotides comprise 19 or more bases. In some embodiments, provided oligonucleotides comprise 20 or more bases. In some embodiments, provided oligonucleotides comprise 21 or more bases. In some embodiments, provided oligonucleotides comprise 22 or more bases. In some embodiments, provided oligonucleotides comprise 23 or more bases. In some embodiments, provided oligonucleotides comprise 24 or more bases. In some embodiments, provided oligonucleotides comprise 25 or more bases. In some embodiments, provided oligonucleotides comprise 26 or more bases. In some embodiments, provided oligonucleotides comprise 27 or more bases. In some embodiments, provided oligonucleotides comprise 28 or more bases. In some embodiments, provided oligonucleotides comprise 29 or more bases. In some embodiments, provided oligonucleotides comprise 30 or more bases. In some embodiments, provided oligonucleotides comprise 40 or more bases. In some embodiments, provided oligonucleotides comprise 50 or more bases. In some embodiments, provided oligonucleotides are 15mers. In some embodiments, provided oligonucleotides are 16mers. In some embodiments, provided oligonucleotides are 17mers. In some embodiments, provided oligonucleotides are 18mers. In some embodiments, provided oligonucleotides are 19mers. In some embodiments, provided oligonucleotides are 20mers. In some embodiments, provided oligonucleotides are 21mers. In some embodiments, provided oligonucleotides are 22mers. In some embodiments, provided oligonucleotides are 23mers. In some embodiments, provided oligonucleotides are 24mers. In some embodiments, provided oligonucleotides are 25mers. In some embodiments, provided oligonucleotides are 26mers. In some embodiments, provided oligonucleotides are 27mers. In some embodiments, provided oligonucleotides are 28mers. In some embodiments, provided oligonucleotides are 29mers. In some embodiments, provided oligonucleotides are 30mers.

In some embodiments, the present disclosure provides a chirally controlled oligonucleotide comprising at least one phosphate diester internucleotidic linkage and at least one phosphorothioate triester linkage having the structure of formula I-c. In some embodiments, the present disclosure provides a chirally controlled oligonucleotide comprising at least one phosphate diester internucleotidic linkage and at least two phosphorothioate triester linkages having the structure of formula I-c. In some embodiments, the present disclosure provides a chirally controlled oligonucleotide comprising at least one phosphate diester internucleotidic linkage and at least three phosphorothioate triester linkages having the structure of formula I-c. In some embodiments, the present disclosure provides a chirally controlled oligonucleotide comprising at least one phosphate diester internucleotidic linkage and at least four phosphorothioate triester linkages having the structure of formula I-c. In some embodiments, the present disclosure provides a chirally controlled oligonucleotide comprising at least one phosphate diester internucleotidic linkage and at least five phosphorothioate triester linkages having the structure of formula I-c.

In some embodiments, the present disclosure provides a chirally controlled oligonucleotide comprising a sequence found in UCAAGGAAGAUGGCAUUUCU (SEQ ID NO: 54). In some embodiments, the present disclosure provides a chirally controlled oligonucleotide comprising a sequence found in UCAAGGAAGAUGGCAUUUCU (SEQ ID NO: 54), wherein one or more U is replaced with T. In some embodiments, the present disclosure provides a chirally controlled oligonucleotide comprising a sequence found in UCAAGGAAGAUGGCAUUUCU (SEQ ID NO: 54), wherein the said sequence has over 50% identity with UCAAGGAAGAUGGCAUUUCU (SEQ ID NO: 54). In some embodiments, the present disclosure provides a chirally controlled oligonucleotide comprising a sequence found in UCAAGGAAGAUGGCAUUUCU (SEQ ID NO: 54), wherein the said sequence has over 60% identity with UCAAGGAAGAUGGCAUUUCU (SEQ ID NO: 54). In some embodiments, the present disclosure provides a chirally controlled oligonucleotide comprising a sequence found in UCAAGGAAGAUGGCAUUUCU (SEQ ID NO: 54), wherein the said sequence has over 70% identity with UCAAGGAAGAUGGCAUUUCU (SEQ ID NO: 54). In some embodiments, the present disclosure provides a chirally controlled oligonucleotide comprising a sequence found in UCAAGGAAGAUGGCAUUUCU (SEQ ID NO: 54), wherein the said sequence has over 80% identity with UCAAGGAAGAUGGCAUUUCU (SEQ ID NO: 54). In some embodiments, the present disclosure provides a chirally controlled oligonucleotide comprising a sequence found in UCAAGGAAGAUGGCAUUUCU (SEQ ID NO: 54), wherein the said sequence has over 90% identity with UCAAGGAAGAUGGCAUUUCU (SEQ ID NO: 54). In some embodiments, the present disclosure provides a chirally controlled oligonucleotide comprising a sequence found in UCAAGGAAGAUGGCAUUUCU (SEQ ID NO: 54), wherein the said sequence has over 95% identity with UCAAGGAAGAUGGCAUUUCU (SEQ ID NO: 54). In some embodiments, the present disclosure provides a chirally controlled oligonucleotide comprising the sequence of UCAAGGAAGAUGGCAUUUCU (SEQ ID NO: 54). In some embodiments, the present disclosure provides a chirally controlled oligonucleotide having the sequence of UCAAGGAAGAUGGCAUUUCU (SEQ ID NO: 54). In some embodiments, the present disclosure provides a chirally controlled oligonucleotide comprising a sequence found in UCAAGGAAGAUGGCAUUUCU (SEQ ID NO: 54), wherein the oligonucleotides have a pattern of backbone linkages, pattern of backbone chiral centers, and/or pattern of backbone phosphorus modifications described herein.

In some embodiments, the present disclosure provides a chirally controlled oligonucleotide comprising a sequence found in GGCACAAGGGCACAGACTTC (SEQ ID NO: 34). In some embodiments, the present disclosure provides a chirally controlled oligonucleotide comprising a sequence found in GGCACAAGGGCACAGACTTC (SEQ ID NO: 34), wherein one or more T is substituted with U. In some embodiments, the present disclosure provides a chirally controlled oligonucleotide comprising a sequence found in GGCACAAGGGCACAGACTTC (SEQ ID NO: 34), wherein the said sequence has over 50% identity with GGCACAAGGGCACAGACTTC (SEQ ID NO: 34). In some embodiments, the present disclosure provides a chirally controlled oligonucleotide comprising a sequence found in GGCACAAGGGCACAGACTTC (SEQ ID NO: 34), wherein the said sequence has over 60% identity with GGCACAAGGGCACAGACTTC (SEQ ID NO: 34). In some embodiments, the present disclosure provides a chirally controlled oligonucleotide comprising a sequence found in GGCACAAGGGCACAGACTTC (SEQ ID NO: 34), wherein the said sequence has over 70% identity with GGCACAAGGGCACAGACTTC (SEQ ID NO: 34). In some embodiments, the present disclosure provides a chirally controlled oligonucleotide comprising a sequence found in GGCACAAGGGCACAGACTTC (SEQ ID NO: 34), wherein the said sequence has over 80% identity with GGCACAAGGGCACAGACTTC (SEQ ID NO: 34). In some embodiments, the present disclosure provides a chirally controlled oligonucleotide comprising a sequence found in GGCACAAGGGCACAGACTTC (SEQ ID NO: 34), wherein the said sequence has over 90% identity with GGCACAAGGGCACAGACTTC (SEQ ID NO: 34). In some embodiments, the present disclosure provides a chirally controlled oligonucleotide comprising a sequence found in GGCACAAGGGCACAGACTTC (SEQ ID NO:

34), wherein the said sequence has over 95% identity with GGCACAAGGGCACAGACTTC (SEQ ID NO: 34). In some embodiments, the present disclosure provides a chirally controlled oligonucleotide comprising the sequence of GGCACAAGGGCACAGACTTC (SEQ ID NO: 34). In some embodiments, the present disclosure provides a chirally controlled oligonucleotide having the sequence of GGCACAAGGGCACAGACTTC (SEQ ID NO: 34).

In some embodiments, the present disclosure provides a chirally controlled oligonucleotide comprising a sequence found in GGCACAAGGGCACAGACTTC (SEQ ID NO: 34), wherein at least one internucleotidic linkage has a chiral linkage phosphorus. In some embodiments, the present disclosure provides a chirally controlled oligonucleotide comprising a sequence found in GGCACAAGGGCACAGACTTC (SEQ ID NO: 34), wherein at least one internucleotidic linkage has the structure of formula I. In some embodiments, the present disclosure provides a chirally controlled oligonucleotide comprising a sequence found in GGCACAAGGGCACAGACTTC (SEQ ID NO: 34), wherein each internucleotidic linkage has the structure of formula I. In some embodiments, the present disclosure provides a chirally controlled oligonucleotide comprising a sequence found in GGCACAAGGGCACAGACTTC (SEQ ID NO: 34), wherein at least one internucleotidic linkage has the structure of formula I-c. In some embodiments, the present disclosure provides a chirally controlled oligonucleotide comprising a sequence found in GGCACAAGGGCACAGACTTC (SEQ ID NO: 34), wherein each internucleotidic linkage has the structure of formula I-c. In some embodiments, the present disclosure provides a chirally controlled oligonucleotide comprising a sequence found in GGCACAAGGGCACAGACTTC (SEQ ID NO: 34), wherein at least one internucleotidic linkage is

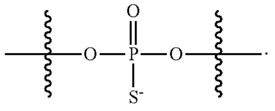

In some embodiments, the present disclosure provides a chirally controlled oligonucleotide comprising a sequence found in GGCACAAGGGCACAGACTTC (SEQ ID NO: 34), wherein each internucleotidic linkage is

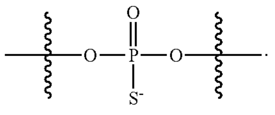

In some embodiments, the present disclosure provides a chirally controlled oligonucleotide comprising a sequence found in GGCACAAGGGCACAGACTTC (SEQ ID NO: 34), wherein at least one internucleotidic linkage is

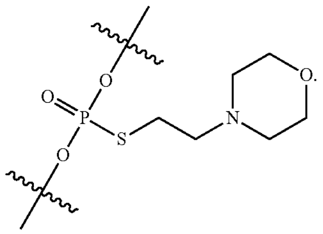

In some embodiments, the present disclosure provides a chirally controlled oligonucleotide comprising a sequence found in GGCACAAGGGCACAGACTTC (SEQ ID NO: 34), wherein each internucleotidic linkage is

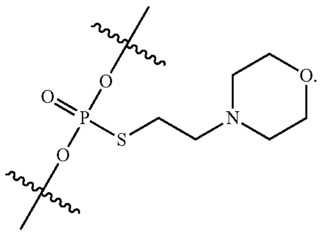

In some embodiments, the present disclosure provides a chirally controlled oligonucleotide comprising the sequence of GGCACAAGGGCACAGACTTC (SEQ ID NO: 34), wherein at least one internucleotidic linkage has a chiral linkage phosphorus. In some embodiments, the present disclosure provides a chirally controlled oligonucleotide comprising the sequence of GGCACAAGGGCACAGACTTC (SEQ ID NO: 34), wherein at least one internucleotidic linkage has the structure of formula I. In some embodiments, the present disclosure provides a chirally controlled oligonucleotide comprising the sequence of GGCACAAGGGCACAGACTTC (SEQ ID NO: 34), wherein each internucleotidic linkage has the structure of formula I. In some embodiments, the present disclosure provides a chirally controlled oligonucleotide comprising the sequence of GGCACAAGGGCACAGACTTC (SEQ ID NO: 34), wherein at least one internucleotidic linkage has the structure of formula I-c. In some embodiments, the present disclosure provides a chirally controlled oligonucleotide comprising the sequence of GGCACAAGGGCACAGACTTC (SEQ ID NO: 34), wherein each internucleotidic linkage has the structure of formula I-c. In some embodiments, the present disclosure provides a chirally controlled oligonucleotide comprising the sequence of GGCACAAGGGCACAGACTTC (SEQ ID NO: 34), wherein at least one internucleotidic linkage is

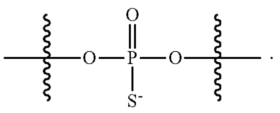

In some embodiments, the present disclosure provides a chirally controlled oligonucleotide comprising the sequence of GGCACAAGGGCACAGACTTC (SEQ ID NO: 34), wherein each internucleotidic linkage is

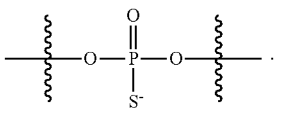

In some embodiments, the present disclosure provides a chirally controlled oligonucleotide comprising the sequence of GGCACAAGGGCACAGACTTC (SEQ ID NO: 34), wherein at least one internucleotidic linkage is

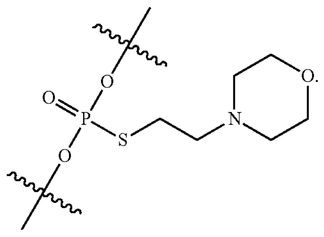

In some embodiments, the present disclosure provides a chirally controlled oligonucleotide comprising the sequence of GGCACAAGGGCACAGACTTC (SEQ ID NO: 34), wherein each internucleotidic linkage is

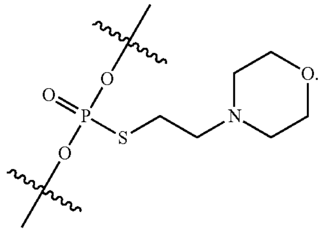

In some embodiments, the present disclosure provides a chirally controlled oligonucleotide having the sequence of GGCACAAGGGCACAGACTTC (SEQ ID NO: 34), wherein at least one internucleotidic linkage has a chiral linkage phosphorus. In some embodiments, the present disclosure provides a chirally controlled oligonucleotide having the sequence of GGCACAAGGGCACAGACTTC (SEQ ID NO: 34), wherein at least one internucleotidic linkage has the structure of formula I. In some embodiments, the present disclosure provides a chirally controlled oligonucleotide having the sequence of GGCACAAGGGCACAGACTTC (SEQ ID NO: 34), wherein each internucleotidic linkage has the structure of formula I. In some embodiments, the present disclosure provides a chirally controlled oligonucleotide having the sequence of GGCACAAGGGCACAGACTTC (SEQ ID NO: 34), wherein at least one internucleotidic linkage has the structure of formula I-c. In some embodiments, the present disclosure provides a chirally controlled oligonucleotide having the sequence of GGCACAAGGGCACAGACTTC (SEQ ID NO: 34), wherein each internucleotidic linkage has the structure of formula I-c. In some embodiments, the present disclosure provides a chirally controlled oligonucleotide having the sequence of GGCACAAGGGCACAGACTTC (SEQ ID NO: 34), wherein at least one internucleotidic linkage is

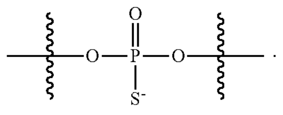

In some embodiments, the present disclosure provides a chirally controlled oligonucleotide having the sequence of GGCACAAGGGCACAGACTTC (SEQ ID NO: 34), wherein each internucleotidic linkage is

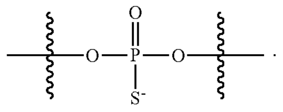

In some embodiments, the present disclosure provides a chirally controlled oligonucleotide having the sequence of GGCACAAGGGCACAGACTTC (SEQ ID NO: 34), wherein at least one internucleotidic linkage is

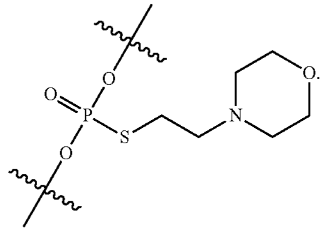

In some embodiments, the present disclosure provides a chirally controlled oligonucleotide having the sequence of GGCACAAGGGCACAGACTTC (SEQ ID NO: 34), wherein each internucleotidic linkage is

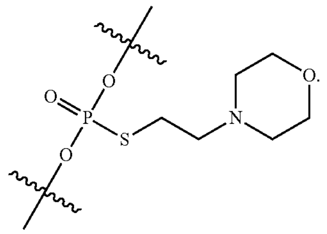

In some embodiments, the present disclosure provides a chirally controlled oligonucleotide having the sequence of GGCACAAGGGCACAGACTTC (SEQ ID NO: 34), wherein at least one linkage phosphorus is Rp. It is understood by a person of ordinary skill in the art that in certain embodiments wherein the chirally controlled oligonucleotide comprises an RNA sequence, each T is independently and optionally replaced with U. In some embodiments, the present disclosure provides a chirally controlled oligonucleotide having the sequence of GGCACAAGGGCACAGACTTC (SEQ ID NO: 34), wherein each linkage phosphorus is Rp. In some embodiments, the present disclosure provides a chirally controlled oligonucleotide having the sequence of GGCACAAGGGCACAGACTTC (SEQ ID NO: 34), wherein at least one linkage phosphorus is Sp. In some embodiments, the present disclosure provides a chirally controlled oligonucleotide having the sequence of GGCACAAGGGCACAGACTTC (SEQ ID NO: 34), wherein each linkage phosphorus is Sp. In some embodiments, the present disclosure provides a chirally controlled oligonucleotide having the sequence of GGCACAAGGGCACAGACTTC (SEQ ID NO: 34), wherein the oligonucleotide is a blockmer. In some embodiments, the present disclosure provides a chirally controlled oligonucleotide having the sequence of GGCACAAGGGCACAGACTTC (SEQ ID NO: 34), wherein the oligonucleotide is a stereoblockmer. In some embodiments, the present disclosure provides a chirally controlled oligonucleotide having the sequence of GGCACAAGGGCACAGACTTC (SEQ ID NO: 34), wherein the oligonucleotide is a P-modification blockmer. In some embodiments, the present disclosure provides a chirally controlled oligonucleotide having the sequence of GGCACAAGGGCACAGACTTC (SEQ ID NO: 34), wherein the oligonucleotide is a linkage blockmer. In some embodiments, the present disclosure provides a chirally controlled oligonucleotide having the sequence of GGCACAAGGGCACAGACTTC (SEQ ID NO: 34), wherein the oligonucleotide is an altmer. In some embodiments, the present disclosure provides a chirally controlled oligonucleotide having the sequence of GGCACAAGGGCACAGACTTC (SEQ ID NO: 34), wherein the oligonucleotide is a stereoaltmer. In some embodiments, the present disclosure provides a chirally controlled oligonucleotide having the sequence of GGCACAAGGGCACAGACTTC (SEQ ID NO: 34), wherein the oligonucleotide is a P-modification altmer. In some embodiments, the present disclosure provides a chirally controlled oligonucleotide having the sequence of GGCACAAGGGCACAGACTTC (SEQ ID NO: 34), wherein the oligonucleotide is a linkage altmer. In some embodiments, the present disclosure provides a chirally controlled oligonucleotide having the sequence of GGCACAAGGGCACAGACTTC (SEQ ID NO: 34), wherein the oligonucleotide is a unimer. In some embodiments, the present disclosure provides a chirally controlled oligonucleotide having the sequence of GGCACAAGGGCACAGACTTC (SEQ ID NO: 34), wherein the oligonucleotide is a stereounimer. In some embodiments, the present disclosure provides a chirally controlled oligonucleotide having the sequence of GGCACAAGGGCACAGACTTC (SEQ ID NO: 34), wherein the oligonucleotide is a P-modification unimer. In some embodiments, the present disclosure provides a chirally controlled oligonucleotide having the sequence of GGCACAAGGGCACAGACTTC (SEQ ID NO: 34), wherein the oligonucleotide is a linkage unimer. In some embodiments, the present disclosure provides a chirally controlled oligonucleotide having the sequence of GGCACAAGGGCACAGACTTC (SEQ ID NO: 34), wherein the oligonucleotide is a gapmer. In some embodiments, the present disclosure provides a chirally controlled oligonucleotide having the sequence of GGCACAAGGGCACAGACTTC (SEQ ID NO: 34), wherein the oligonucleotide is a skipmer.

In some embodiments, the present disclosure provides a chirally controlled oligonucleotide having the sequence of GGCACAAGGGCACAGACTTC (SEQ ID NO: 34), wherein each cytosine is optionally and independently replaced by 5-methylcytosine. In some embodiments, the present disclosure provides a chirally controlled oligonucleotide having the sequence of GGCACAAGGGCACAGACTTC (SEQ ID NO: 34), wherein at least one cytosine is optionally and independently replaced by 5-methylcytosine. In some embodiments, the present disclosure provides a chirally controlled oligonucleotide having the sequence of GGCACAAGGGCACAGACTTC (SEQ ID NO: 34), wherein each cytosine is optionally and independently replaced by 5-methylcytosine.

In some embodiments, a chirally controlled oligonucleotide is designed such that one or more nucleotides comprise a phosphorus modification prone to "autorelease" under certain conditions. That is, under certain conditions, a particular phosphorus modification is designed such that it self-cleaves from the oligonucleotide to provide, e.g., a phosphate diester such as those found in naturally occurring DNA and RNA. In some embodiments, such a phosphorus modification has a structure of —O-L-$R^1$, wherein each of L and $R^1$ is independently as defined above and described herein. In some embodiments, an autorelease group comprises a morpholino group. In some embodiments, an autorelease group is characterized by the ability to deliver an agent to the internucleotidic phosphorus linker, which agent facilitates further modification of the phosphorus atom such as, e.g., desulfurization. In some embodiments, the agent is water and the further modification is hydrolysis to form a phosphate diester as is found in naturally occurring DNA and RNA.

In some embodiments, a chirally controlled oligonucleotide is designed such that the resulting pharmaceutical properties are improved through one or more particular modifications at phosphorus. It is well documented in the art that certain oligonucleotides are rapidly degraded by nucleases and exhibit poor cellular uptake through the cytoplasmic cell membrane (Poijarvi-Virta et al., Curr. Med. Chem. (2006), 13(28); 3441-65; Wagner et al., Med. Res. Rev. (2000), 20(6):417-51; Peyrottes et al., Mini Rev. Med. Chem. (2004), 4(4):395-408; Gosselin et al., (1996), 43(1): 196-208; Bologna et al., (2002), Antisense & Nucleic Acid Drug Development 12:33-41). For instance, Vives et al., (Nucleic Acids Research (1999), 27(20):4071-76) found that tert-butyl SATE pro-oligonucleotides displayed markedly increased cellular penetration compared to the parent oligonucleotide.

In some embodiments, a modification at a linkage phosphorus is characterized by its ability to be transformed to a phosphate diester, such as those present in naturally occurring DNA and RNA, by one or more esterases, nucleases, and/or cytochrome P450 enzymes, including but not limited to, those listed in Table 1, below.

TABLE 1

Example enzymes.

| Family | Gene |
|---|---|
| CYP1 | CYP1A1, CYP1A2, CYP1B1 |
| CYP2 | CYP2A6, CYP2A7, CYP2A13, CYP2B6, CYP2C8, CYP2C9, CYP2C18, CYP2C19, CYP2D6, CYP2E1, CYP2F1, CYP2J2, CYP2R1, CYP2S1, CYP2U1, CYP2W1 |
| CYP3 | CYP3A4, CYP3A5, CYP3A7, CYP3A43 |
| CYP4 | CYP4A11, CYP4A22, CYP4B1, CYP4F2, CYP4F3, CYP4F8, CYP4F11, CYP4F12, CYP4F22, CYP4V2, CYP4X1, CYP4Z1 |
| CYP5 | CYP5A1 |
| CYP7 | CYP7A1, CYP7B1 |
| CYP8 | CYP8A1 (prostacyclin synthase), CYP8B1 (bile acid biosynthesis) |
| CYP11 | CYP11A1, CYP11B1, CYP11B2 |
| CYP17 | CYP17A1 |
| CYP19 | CYP19A1 |

TABLE 1-continued

| Example enzymes. | |
|---|---|
| Family | Gene |
| CYP20 | CYP20A1 |
| CYP21 | CYP21A2 |
| CYP24 | CYP24A1 |
| CYP26 | CYP26A1, CYP26B1, CYP26C1 |
| CYP27 | CYP27A1 (bile acid biosynthesis), CYP27B1 (vitamin D3 1-alpha hydroxylase, activates vitamin D3), CYP27C1 (unknown function) |
| CYP39 | CYP39A1 |
| CYP46 | CYP46A1 |
| CYP51 | CYP51A1 (lanosterol 14-alpha demethylase) |

In some embodiments, a modification at phosphorus results in a P-modification moiety characterized in that it acts as a pro-drug, e.g., the P-modification moiety facilitates delivery of an oligonucleotide to a desired location prior to removal. For instance, in some embodiments, a P-modification moiety results from PEGylation at the linkage phosphorus. One of skill in the relevant arts will appreciate that various PEG chain lengths are useful and that the selection of chain length will be determined in part by the result that is sought to be achieved by PEGylation. For instance, in some embodiments, PEGylation is effected in order to reduce RES uptake and extend in vivo circulation lifetime of an oligonucleotide.

In some embodiments, a PEGylation reagent for use in accordance with the present disclosure is of a molecular weight of about 300 g/mol to about 100,000 g/mol. In some embodiments, a PEGylation reagent is of a molecular weight of about 300 g/mol to about 10,000 g/mol. In some embodiments, a PEGylation reagent is of a molecular weight of about 300 g/mol to about 5,000 g/mol. In some embodiments, a PEGylation reagent is of a molecular weight of about 500 g/mol. In some embodiments, a PEGylation reagent of a molecular weight of about 1000 g/mol. In some embodiments, a PEGylation reagent is of a molecular weight of about 3000 g/mol. In some embodiments, a PEGylation reagent is of a molecular weight of about 5000 g/mol.

In certain embodiments, a PEGylation reagent is PEG500. In certain embodiments, a PEGylation reagent is PEG1000. In certain embodiments, a PEGylation reagent is PEG3000. In certain embodiments, a PEGylation reagent is PEG5000.

In some embodiments, a P-modification moiety is characterized in that it acts as a PK enhancer, e.g., lipids, PEGylated lipids, etc.

In some embodiments, a P-modification moiety is characterized in that it acts as an agent which promotes cell entry and/or endosomal escape, such as a membrane-disruptive lipid or peptide.

In some embodiments, a P-modification moiety is characterized in that it acts as a targeting agent. In some embodiments, a P-modification moiety is or comprises a targeting agent. The phrase "targeting agent," as used herein, is an entity that is associates with a payload of interest (e.g., with an oligonucleotide or oligonucleotide composition) and also interacts with a target site of interest so that the payload of interest is targeted to the target site of interest when associated with the targeting agent to a materially greater extent than is observed under otherwise comparable conditions when the payload of interest is not associated with the targeting agent. A targeting agent may be, or comprise, any of a variety of chemical moieties, including, for example, small molecule moieties, nucleic acids, polypeptides, carbohydrates, etc. Targeting agents are described further by Adarsh et al., "Organelle Specific Targeted Drug Delivery—A Review," International Journal of Research in Pharmaceutical and Biomedical Sciences, 2011, p. 895.

Examples of such targeting agents include, but are not limited to, proteins (e.g. Transferrin), oligopeptides (e.g., cyclic and acylic RGD-containing oligopeptides), antibodies (monoclonal and polyclonal antibodies, e.g. IgG, IgA, IgM, IgD, IgE antibodies), sugars/carbohydrates (e.g., monosaccharides and/or oligosaccharides (mannose, mannose-6-phosphate, galactose, and the like)), vitamins (e.g., folate), or other small biomolecules. In some embodiments, a targeting moiety is a steroid molecule (e.g., bile acids including cholic acid, deoxycholic acid, dehydrocholic acid; cortisone; digoxigenin; testosterone; cholesterol; cationic steroids such as cortisone having a trimethylaminomethyl hydrazide group attached via a double bond at the 3-position of the cortisone ring, etc.). In some embodiments, a targeting moiety is a lipophilic molecule (e.g., alicyclic hydrocarbons, saturated and unsaturated fatty acids, waxes, terpenes, and polyalicyclic hydrocarbons such as adamantine and buckminsterfullerenes). In some embodiments, a lipophilic molecule is a terpenoid such as vitamin A, retinoic acid, retinal, or dehydroretinal. In some embodiments, a targeting moiety is a peptide.

In some embodiments, a P-modification moiety is a targeting agent of formula —X-L-$R^1$ wherein each of X, L, and $R^1$ are as defined in Formula I above.

In some embodiments, a P-modification moiety is characterized in that it facilitates cell specific delivery.

In some embodiments, a P-modification moiety is characterized in that it falls into one or more of the above-described categories. For instance, in some embodiments, a P-modification moiety acts as a PK enhancer and a targeting ligand. In some embodiments, a P-modification moiety acts as a pro-drug and an endosomal escape agent. One of skill in the relevant arts would recognize that numerous other such combinations are possible and are contemplated by the present disclosure.

In some embodiments, a carbocyclyl, aryl, heteroaryl, or heterocyclyl group, or a bivalent or polyvalent group thereof, is a $C_3$-$C_{30}$ carbocyclyl, aryl, heteroaryl, or heterocyclyl group, or a bivalent and/or polyvalent group thereof.

Nucleobases

In some embodiments, a nucleobase present in a provided oligonucleotide is a natural nucleobase or a modified nucleobase derived from a natural nucleobase. Examples include, but are not limited to, uracil, thymine, adenine, cytosine, and guanine having their respective amino groups protected by acyl protecting groups, 2-fluorouracil, 2-fluorocytosine, 5-bromouracil, 5-iodouracil, 2,6-diaminopurine, azacytosine, pyrimidine analogs such as pseudoisocytosine and pseudouracil and other modified nucleobases such as 8-substituted purines, xanthine, or hypoxanthine (the latter two being the natural degradation products). Example modified nucleobases are disclosed in Chiu and Rana, *RNA,* 2003, 9, 1034-1048, Limbach et al. *Nucleic Acids Research,* 1994, 22, 2183-2196 and Revankar and Rao, *Comprehensive Natural Products Chemistry*, vol. 7, 313. In some embodiments, a modified nucleobase is substituted uracil, thymine, adenine, cytosine, or guanine. In some embodiments, a modified nucleobase is a functional replacement, e.g., in terms of hydrogen bonding and/or base pairing, of uracil, thymine, adenine, cytosine, or guanine. In some embodiments, a nucleobase is optionally substituted uracil, thymine, adenine, cytosine, 5-methylcytosine, or guanine. In some embodiments, a nucleobase is uracil, thymine, adenine, cytosine, 5-methylcytosine, or guanine.

In some embodiments, a modified base is optionally substituted adenine, cytosine, guanine, thymine, or uracil. In some embodiments, a modified nucleobase is independently adenine, cytosine, guanine, thymine or uracil, modified by one or more modifications by which:

(1) a nucleobase is modified by one or more optionally substituted groups independently selected from acyl, halogen, amino, azide, alkyl, alkenyl, alkynyl, aryl, heteroalkyl, heteroalkenyl, heteroalkynyl, heterocyclyl, heteroaryl, carboxyl, hydroxyl, biotin, avidin, streptavidin, substituted silyl, and combinations thereof;

(2) one or more atoms of a nucleobase are independently replaced with a different atom selected from carbon, nitrogen or sulfur;

(3) one or more double bonds in a nucleobase are independently hydrogenated; or (4) one or more aryl or heteroaryl rings are independently inserted into a nucleobase.

Compounds represented by the following general formulae are also contemplated as modified nucleobases:

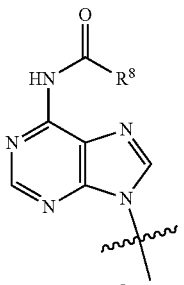
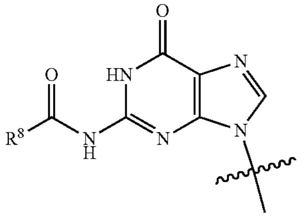
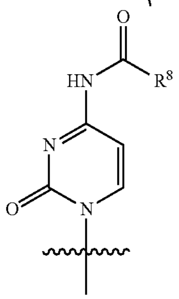
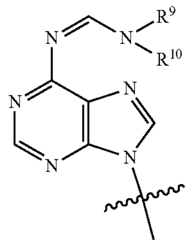
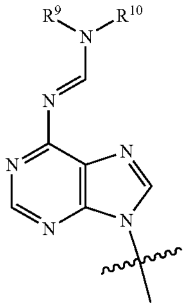
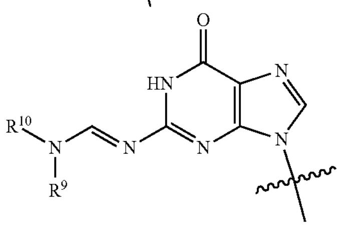

-continued

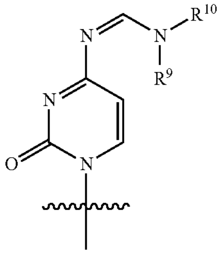
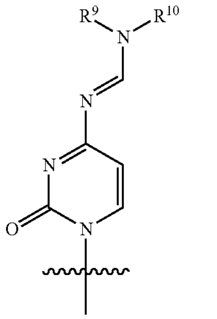
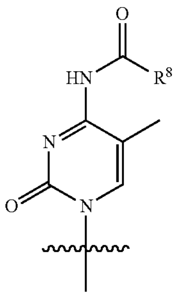
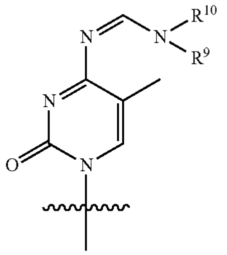
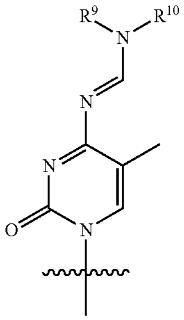

wherein $R^1$ is an optionally substituted, linear or branched group selected from aliphatic, aryl, aralkyl, aryloxylalkyl, carbocyclyl, heterocyclyl or heteroaryl group having 1 to 15 carbon atoms, including, by way of example only, a methyl, isopropyl, phenyl, benzyl, or phenoxymethyl group; and each of $R^9$ and $R^{10}$ is independently an optionally substituted group selected from linear or branched aliphatic, carbocyclyl, aryl, heterocyclyl and heteroaryl.

Modified nucleobases also include expanded-size nucleobases in which one or more aryl rings, such as phenyl rings, have been added. Nucleic base replacements described in the Glen Research catalog (www.glenresearch.com); Krueger A T et al, *Acc. Chem. Res.,* 2007, 40, 141-150; Kool, ET, *Acc. Chem. Res.,* 2002, 35, 936-943; Benner S. A., et al., *Nat. Rev. Genet.,* 2005, 6, 553-543; Romesberg, F. E., et al., *Curr. Opin. Chem. Biol.,* 2003, 7, 723-733; Hirao, I., *Curr. Opin. Chem. Biol.,* 2006, 10, 622-627, are contemplated as useful for the synthesis of the nucleic acids described herein. Some examples of these expanded-size nucleobases are shown below:

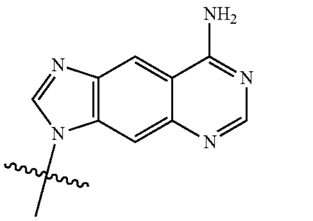

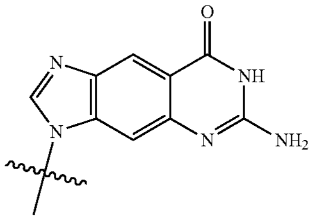

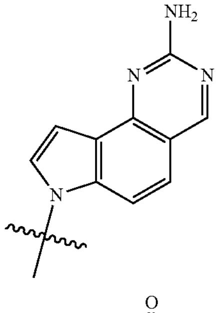

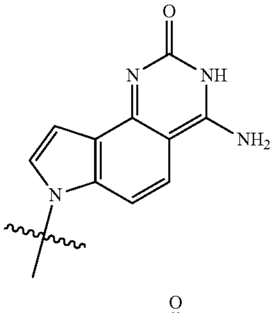

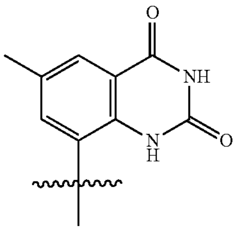

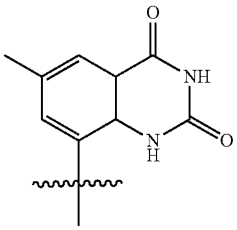

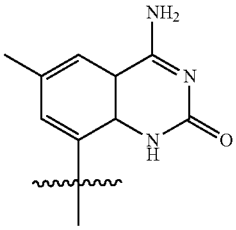

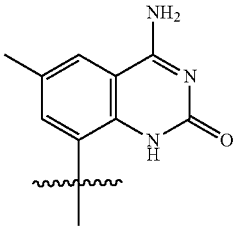

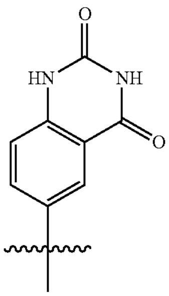

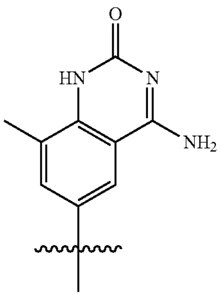

-continued

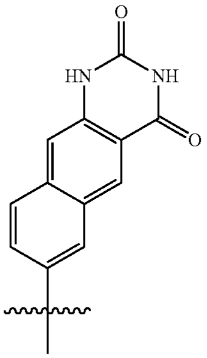

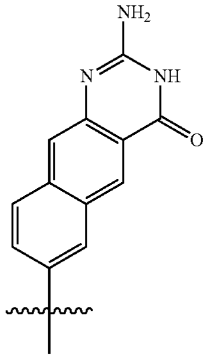

Herein, modified nucleobases also encompass structures that are not considered nucleobases but are other moieties such as, but not limited to, corrin- or porphyrin-derived rings. Porphyrin-derived base replacements have been described in Morales-Rojas, H and Kool, ET, *Org. Lett.*, 2002, 4, 4377-4380. Shown below is an example of a porphyrin-derived ring which can be used as a base replacement:

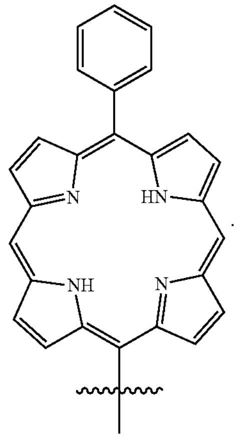 [SMILES: *c1c2nc(cc3ccc([nH]3)c(-c3ccccc3)c3nc(cc4ccc1[nH]4)C=C3)C=C2]

In some embodiments, modified nucleobases are of any one of the following structures, optionally substituted:

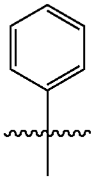

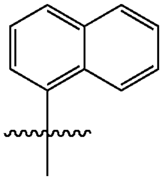

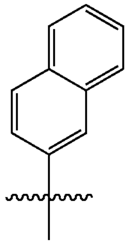

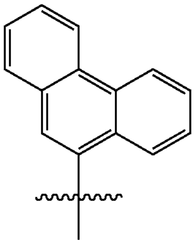

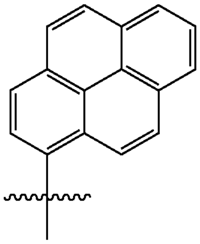

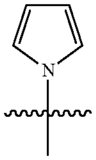

-continued

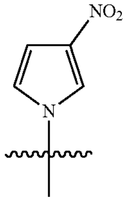

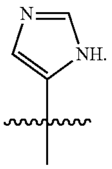

In some embodiments, a modified nucleobase is fluorescent. Examples of such fluorescent modified nucleobases include phenanthrene, pyrene, stillbene, isoxanthine, isozanthopterin, terphenyl, terthiophene, benzoterthiophene, coumarin, lumazine, tethered stillbene, benzo-uracil, and naphtho-uracil, as shown below:

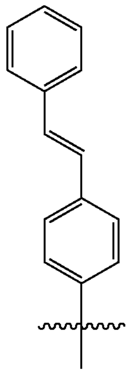

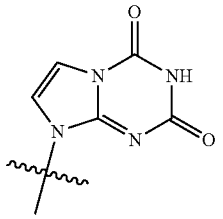

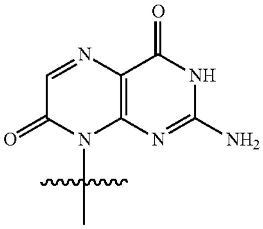

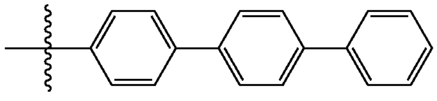

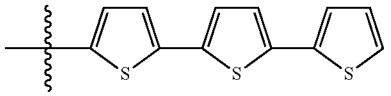

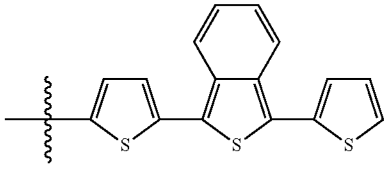

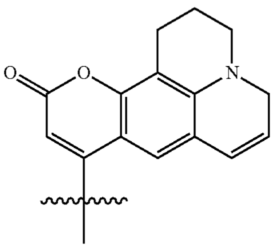

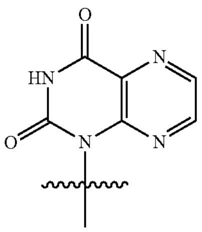

-continued

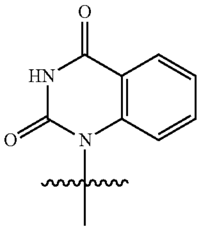

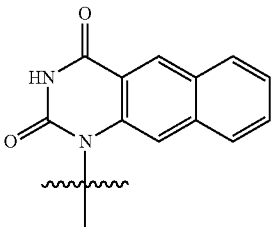

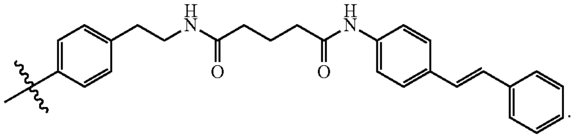

In some embodiments, a modified nucleobase is unsubstituted. In some embodiments, a modified nucleobase is substituted. In some embodiments, a modified nucleobase is substituted such that it contains, e.g., heteroatoms, alkyl groups, or linking moieties connected to fluorescent moieties, biotin or avidin moieties, or other protein or peptides. In some embodiments, a modified nucleobase is a "universal base" that is not a nucleobase in the most classical sense, but that functions similarly to a nucleobase. One representative example of such a universal base is 3-nitropyrrole.

In some embodiments, other nucleosides can also be used in the process disclosed herein and include nucleosides that incorporate modified nucleobases, or nucleobases covalently bound to modified sugars. Some examples of nucleosides that incorporate modified nucleobases include 4-acetylcytidine; 5-(carboxyhydroxylmethyl)uridine; 2'-O-methylcytidine; 5-carboxymethylaminomethyl-2-thiouridine; 5-carboxymethylaminomethyluridine; dihydrouridine; 2'-O-methylpseudouridine; beta,D-galactosylqueosine; 2'-O-methylguanosine; N'-isopentenyladenosine; 1-methyladenosine; 1-methylpseudouridine; 1-methylguanosine; 1-methylinosine; 2,2-dimethylguanosine; 2-methyladenosine; 2-methylguanosine; $N^7$-methylguanosine; 3-methyl-cytidine; 5-methylcytidine; 5-hydroxymethylcytidine; 5-formylcytosine; 5-carboxylcytosine; N-methyladenosine; 7-methylguanosine; 5-methylaminoethyluridine; 5-methoxyaminomethyl-2-thiouridine; beta,D-mannosylqueosine; 5-methoxycarbonylmethyluridine; 5-methoxyuridine; 2-methylthio-N-isopentenyladenosine; N-((9-beta,D-ribofuranosyl-2-methylthiopurine-6-yl)carbamoyl)threonine; N—((9-beta,D-ribofuranosylpurine-6-yl)-N-methylcarbamoyl)threonine; uridine-5-oxyacetic acid methylester; uridine-5-oxyacetic acid (v); pseudouridine; queosine; 2-thiocytidine; 5-methyl-2-thiouridine; 2-thiouridine; 4-thiouridine; 5-methyluridine; 2'-O-methyl-5-methyluridine; and 2'-O-methyluridine.

In some embodiments, nucleosides include 6'-modified bicyclic nucleoside analogs that have either (R) or (S)-chirality at the 6'-position and include the analogs described in U.S. Pat. No. 7,399,845. In other embodiments, nucleosides include 5'-modified bicyclic nucleoside analogs that have either (R) or (S)-chirality at the 5'-position and include the analogs described in US Patent Application Publication No. 20070287831.

In some embodiments, a nucleobase or modified nucleobase comprises one or more biomolecule binding moieties such as e.g., antibodies, antibody fragments, biotin, avidin, streptavidin, receptor ligands, or chelating moieties. In other embodiments, a nucleobase or modified nucleobase is 5-bromouracil, 5-iodouracil, or 2,6-diaminopurine. In some embodiments, a nucleobase or modified nucleobase is modified by substitution with a fluorescent or biomolecule binding moiety. In some embodiments, the substituent on a nucleobase or modified nucleobase is a fluorescent moiety. In some embodiments, the substituent on a nucleobase or modified nucleobase is biotin or avidin.

Representative U.S. patents that teach the preparation of certain of the above noted modified nucleobases as well as other modified nucleobases include, but are not limited to, the above noted U.S. Pat. No. 3,687,808, as well as U.S. Pat. Nos. 4,845,205; 5,130,30; 5,134,066; 5,175,273; 5,367,066; 5,432,272; 5,457,187; 5,457,191; 5,459,255; 5,484,908; 5,502,177; 5,525,711; 5,552,540; 5,587,469; 5,594,121, 5,596,091; 5,614,617; 5,681,941; 5,750,692; 6,015,886; 6,147,200; 6,166,197; 6,222,025; 6,235,887; 6,380,368; 6,528,640; 6,639,062; 6,617,438; 7,045,610; 7,427,672; and 7,495,088, the modified nucleobases, sugars, and internucleotidic linkages of each of which are incorporated by reference.

In some embodiments, a base is optionally substituted A, T, C, G or U, wherein one or more —$NH_2$ are independently and optionally replaced with —$C(\text{-L-}R^1)_3$, one or more —NH— are independently and optionally replaced with —$C(\text{-L-}R^1)_2$—, one or more ═N— are independently and optionally replaced with —$C(\text{-L-}R^1)$—, one or more ═CH— are independently and optionally replaced with ═N—, and one or more ═O are independently and optionally replaced with ═S, ═$N(\text{-L-}R^1)$, or ═$C(\text{-L-}R^1)_2$, wherein two or more -L-$R^1$ are optionally taken together with their intervening atoms to form a 3-30 membered bicyclic or polycyclic ring having 0-10 heteroatom ring atoms. In some embodiments, a modified base is optionally substituted A, T, C, G or U, wherein one or more —$NH_2$ are independently and optionally replaced with —$C(\text{-L-}R^1)_3$, one or more —NH— are independently and optionally replaced with —$C(\text{-L-}R^1)_2$—, one or more ═N— are independently and optionally replaced with —$C(\text{-L-}R^1)$—, one or more ═CH— are independently and optionally replaced with ═N—, and one or more ═O are independently and optionally replaced with ═S, ═$N(\text{-L-}R^1)$, or ═$C(\text{-L-}R^1)_2$, wherein two or more -L-$R^1$ are optionally taken together with their intervening atoms to form a 3-30 membered bicyclic or polycyclic ring having 0-10 heteroatom ring atoms, wherein the modified base is different than the natural A, T, C, G and U. In some embodiments, a base is optionally substituted A, T, C, G or U. In some embodiments, a modified base is substituted A, T, C, G or U, wherein the modified base is different than the natural A, T, C, G and U.

In some embodiments, a modified nucleotide or nucleotide analog is any modified nucleotide or nucleotide analog described in any of: Gryaznov, S; Chen, J.-K. J. Am. Chem. Soc. 1994, 116, 3143; Hendrix et al. 1997 Chem. Eur. J. 3: 110; Hyrup et al. 1996 Bioorg. Med. Chem. 4: 5; Jepsen et al. 2004 Oligo. 14: 130-146; Jones et al. J. Org. Chem. 1993, 58, 2983; Koizumi et al. 2003 Nuc. Acids Res. 12: 3267-3273; Koshkin et al. 1998 Tetrahedron 54: 3607-3630; Kumar et al. 1998 Bioo. Med. Chem. Let. 8: 2219-2222; Lauritsen et al. 2002 Chem. Comm. 5: 530-531; Lauritsen et al. 2003 Bioo. Med. Chem. Lett. 13: 253-256; Mesmaeker et al. Angew. Chem., Int. Ed. Engl. 1994, 33, 226; Morita et al. 2001 Nucl. Acids Res. Supp. 1: 241-242; Morita et al. 2002 Bioo. Med. Chem. Lett. 12: 73-76; Morita et al. 2003 Bioo. Med. Chem. Lett. 2211-2226; Nielsen et al. 1997 Chem. Soc. Rev. 73; Nielsen et al. 1997 J. Chem. Soc. Perkins Transl. 1: 3423-3433; Obika et al. 1997 Tetrahedron Lett. 38 (50): 8735-8; Obika et al. 1998 Tetrahedron Lett. 39: 5401-5404; Pallan et al. 2012 Chem. Comm. 48: 8195-8197; Petersen et al. 2003 TRENDS Biotech. 21: 74-81; Rajwanshi et al. 1999 Chem. Commun. 1395-1396; Schultz et al. 1996 Nucleic Acids Res. 24: 2966; Seth et al. 2009 J. Med. Chem. 52: 10-13; Seth et al. 2010 J. Med. Chem. 53: 8309-8318; Seth et al. 2010 J. Org. Chem. 75: 1569-1581; Seth et al. 2012 Bioo. Med. Chem. Lett. 22: 296-299; Seth et al. 2012 Mol. Ther-Nuc. Acids. 1, e47; Seth, Punit P; Siwkowski, Andrew; Allerson, Charles R; Vasquez, Guillermo; Lee, Sam; Prakash, Thazha P; Kinberger, Garth; Migawa, Michael T; Gaus, Hans; Bhat, Balkrishen; et al. From Nucleic Acids Symposium Series (2008), 52(1), 553-554; Singh et al. 1998 Chem. Comm. 1247-1248; Singh et al. 1998 J. Org. Chem. 63: 10035-39; Singh et al. 1998 J. Org. Chem. 63: 6078-6079; Sorensen 2003 Chem. Comm. 2130-2131; Ts'o et al. Ann. N. Y. Acad. Sci. 1988, 507, 220; Van Aerschot et al. 1995 Angew. Chem. Int. Ed. Engl. 34: 1338; Vasseur et al. J. Am. Chem. Soc. 1992, 114, 4006; WO 20070900071; WO 20070900071; or WO 2016/079181.

Example nucleobases are also described in US 20110294124, US 20120316224, US 20140194610, US 20150211006, US 20150197540, WO 2015107425, PCT/US2016/043542, and PCT/US2016/043598, each of which is incorporated herein by reference.

Sugars

In some embodiments, provided oligonucleotides comprise one or more modified sugar moieties beside the natural sugar moieties.

The most common naturally occurring nucleotides are comprised of ribose sugars linked to the nucleobases adenosine (A), cytosine (C), guanine (G), and thymine (T) or uracil (U). Also contemplated are modified nucleotides wherein a phosphate group or linkage phosphorus in the nucleotides can be linked to various positions of a sugar or modified sugar. As non-limiting examples, the phosphate group or linkage phosphorus can be linked to the 2', 3', 4' or 5' hydroxyl moiety of a sugar or modified sugar. Nucleotides that incorporate modified nucleobases as described herein are also contemplated in this context. In some embodiments, nucleotides or modified nucleotides comprising an unprotected —OH moiety are used in accordance with methods of the present disclosure.

Other modified sugars can also be incorporated within a provided oligonucleotide. In some embodiments, a modified sugar contains one or more substituents at the 2' position including one of the following: —F; —$CF_3$, —CN, —$N_3$, —NO, —$NO_2$, —OR', —SR', or —$N(R')_2$, wherein each R' is independently as defined above and described herein; —O—($C_1$-$C_{10}$ alkyl), —S—($C_1$-$C_{10}$ alkyl), —NH—($C_1$-$C_{10}$ alkyl), or —N($C_1$-$C_{10}$ alkyl)$_2$; —O—($C_2$-$C_{10}$ alkenyl), —S—($C_2$-$C_{10}$ alkenyl), —NH—($C_2$-$C_{10}$ alkenyl), or —N($C_2$-$C_{10}$ alkenyl)$_2$; —O—($C_2$-$C_{10}$ alkynyl), —S—($C_2$-$C_{10}$ alkynyl), —NH—($C_2$-$C_{10}$ alkynyl), or —N($C_2$-$C_{10}$ alkynyl)$_2$; or —O—($C_1$-$C_{10}$ alkylene)-O—($C_1$-$C_{10}$ alkyl), —O—($C_1$-$C_{10}$ alkylene)-NH—($C_1$-$C_{10}$ alkyl) or —O—($C_1$-$C_{10}$ alkylene)-NH($C_1$-$C_{10}$ alkyl)$_2$, —NH—($C_1$-$C_{10}$ alkylene)-O—($C_1$-$C_{10}$ alkyl), or —N($C_1$-$C_{10}$ alkyl)-($C_1$-$C_{10}$ alkylene)-O—($C_1$-$C_{10}$ alkyl), wherein the alkyl, alkylene, alkenyl and alkynyl may be substituted or unsubstituted.

Examples of substituents include, and are not limited to, $—O(CH_2)_nOCH_3$, and $—O(CH_2)_nNH_2$, wherein n is from 1 to about 10, MOE, DMAOE, DMAEOE. Also contemplated herein are modified sugars described in WO 2001/088198; and Martin et al., Helv. Chim. Acta, 1995, 78, 486-504. In some embodiments, a modified sugar comprises one or more groups selected from a substituted silyl group, an RNA cleaving group, a reporter group, a fluorescent label, an intercalator, a group for improving the pharmacokinetic properties of a nucleic acid, a group for improving the pharmacodynamic properties of a nucleic acid, or other substituents having similar properties. In some embodiments, modifications are made at one or more of the the 2', 3', 4', 5', or 6' positions of the sugar or modified sugar, including the 3' position of the sugar on the 3'-terminal nucleotide or in the 5' position of the 5'-terminal nucleotide. In some embodiments, a RNA comprises a sugar which has, at the 2' position, a 2'-OH, or 2'-$OR^1$, wherein $OR^1$ is optionally substituted alkyl, including 2'-OMe.

In some embodiments, a 2'-modification is 2'-F.

In some embodiments, the 2'-OH of a ribose is replaced with a substituent including one of the following: —H, —F; $—CF_3$, —CN, $—N_3$, —NO, $—NO_2$, —OR', —SR', or $—N(R')_2$, wherein each R' is independently as defined above and described herein; —O—($C_1$-$C_{10}$ alkyl), —S—($C_1$-$C_{10}$ alkyl), —NH—($C_1$-$C_{10}$ alkyl), or —N($C_1$-$C_{10}$ alkyl)$_2$; —O—($C_2$-$C_{10}$ alkenyl), —S—($C_2$-$C_{10}$ alkenyl), —NH—($C_2$-$C_{10}$ alkenyl), or —N($C_2$-$C_{10}$ alkenyl)$_2$; —O—($C_2$-$C_{10}$ alkynyl), —S—($C_2$-$C_{10}$ alkynyl), —NH—($C_2$-$C_{10}$ alkynyl), or —N($C_2$-$C_{10}$ alkynyl)$_2$; or —O—($C_1$-$C_{10}$ alkylene)-O—($C_1$-$C_{10}$ alkyl), —O—($C_1$-$C_{10}$ alkylene)-NH—($C_1$-$C_{10}$ alkyl) or —O—($C_1$-$C_{10}$ alkylene)-NH($C_1$-$C_{10}$ alkyl)$_2$, —NH—($C_1$-$C_{10}$ alkylene)-O—($C_1$-$C_{10}$ alkyl), or —N($C_1$-$C_{10}$ alkyl)-($C_1$-$C_{10}$ alkylene)-O—($C_1$-$C_{10}$ alkyl), wherein the alkyl, alkylene, alkenyl and alkynyl may be substituted or unsubstituted. In some embodiments, the 2'-OH is replaced with —H (deoxyribose). In some embodiments, the 2'-OH is replaced with —F. In some embodiments, the 2'-OH is replaced with —OR'. In some embodiments, the 2'-OH is replaced with —OMe. In some embodiments, the 2'-OH is replaced with $—OCH_2CH_2OMe$.

Modified sugars also include locked nucleic acids (LNAs). In some embodiments, two substituents on sugar carbon atoms are taken together to form a bivalent moiety. In some embodiments, two substituents are on two different sugar carbon atoms. In some embodiments, a formed bivalent moiety has the structure of -L- as defined herein. In some embodiments, -L- is $—O—CH_2—$, wherein $—CH_2—$ is optionally substituted. In some embodiments, -L- is $—O—CH_2—$. In some embodiments, -L- is —O—CH(Et)-. In some embodiments, -L- is between C2 and C4 of a sugar moiety. In some embodiments, a locked nucleic acid has the structure indicated below. A locked nucleic acid of the structure below is indicated, wherein Ba represents a nucleobase or modified nucleobase as described herein, and wherein $R^{2s}$ is $—OCH_2C4'$-.

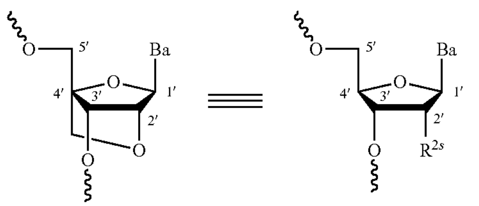

C2'$OCH_2$C4' = LNA (Locked Nucleic Acid)

$R^{2s}$ = $OCH_2$C4'

In some embodiments, a modified sugar is an ENA such as those described in, e.g., Seth et al., J Am Chem Soc. 2010 October 27; 132(42): 14942-14950. In some embodiments, a modified sugar is any of those found in an XNA (xenonucleic acid), for instance, arabinose, anhydrohexitol, threose, 2'fluoroarabinose, or cyclohexene.

Modified sugars include sugar mimetics such as cyclobutyl or cyclopentyl moieties in place of the pentofuranosyl sugar. Representative United States patents that teach the preparation of such modified sugar structures include, but are not limited to, U.S. Pat. Nos. 4,981,957; 5,118,800; 5,319,080; and 5,359,044. Some modified sugars that are contemplated include sugars in which the oxygen atom within the ribose ring is replaced by nitrogen, sulfur, selenium, or carbon. In some embodiments, a modified sugar is a modified ribose wherein the oxygen atom within the ribose ring is replaced with nitrogen, and wherein the nitrogen is optionally substituted with an alkyl group (e.g., methyl, ethyl, isopropyl, etc).

Non-limiting examples of modified sugars include glycerol, which form glycerol nucleic acid (GNA) analogues. One example of a GNA analogue is shown below and is described in Zhang, R et al., *J. Am. Chem. Soc.,* 2008, 130, 5846-5847; Zhang L, et al., *J. Am. Chem. Soc.,* 2005, 127, 4174-4175 and Tsai C H et al., *PNAS,* 2007, 14598-14603 ($X{=}O^-$):

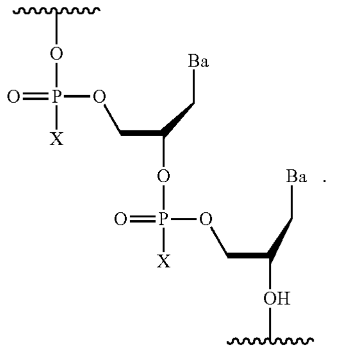

Another example of a GNA derived analogue, flexible nucleic acid (FNA) based on the mixed acetal aminal of formyl glycerol, is described in Joyce G F et al., *PNAS,* 1987, 84, 4398-4402 and Heuberger B D and Switzer C, *J. Am. Chem. Soc.,* 2008, 130, 412-413, and is shown below:

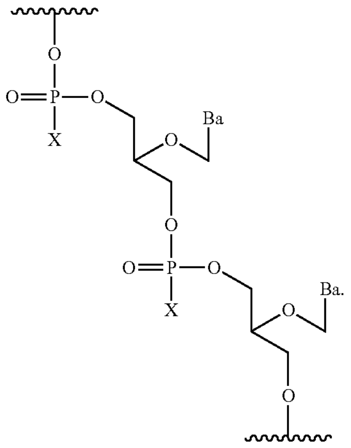

Additional non-limiting examples of modified sugars include hexopyranosyl (6' to 4'), pentopyranosyl (4' to 2'), pentopyranosyl (4' to 3'), or tetrofuranosyl (3' to 2') sugars. In some embodiments, a hexopyranosyl (6' to 4') sugar is of any one in the following formulae:

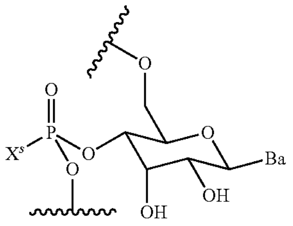

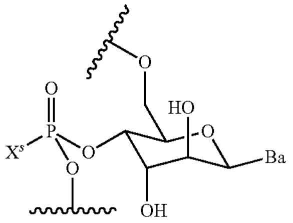

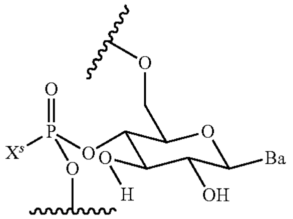

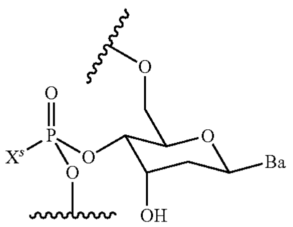

-continued

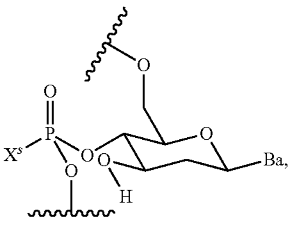

wherein $X^s$ corresponds to the P-modification group "—$XLR^1$" described herein and Ba is as defined herein.

In some embodiments, a pentopyranosyl (4' to 2') sugar is of any one in the following formulae:

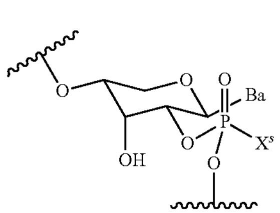

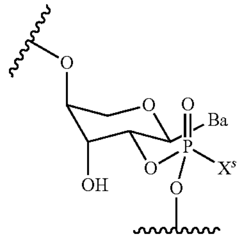

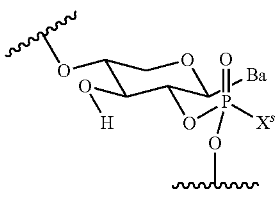

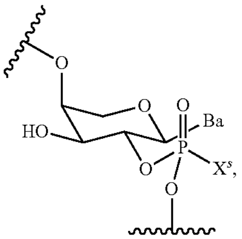

wherein $X^s$ corresponds to the P-modification group "—$XLR^1$" described herein and Ba is as defined herein.

In some embodiments, a pentopyranosyl (4' to 3') sugar is of any one in the following formulae:

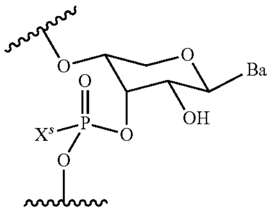

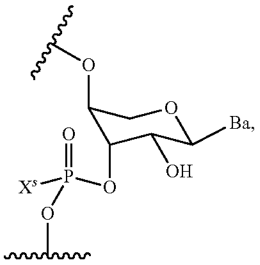

wherein $X^s$ corresponds to the P-modification group "—$XLR^1$" described herein and Ba is as defined herein.

In some embodiments, a tetrofuranosyl (3' to 2') sugar is of either in the following formulae:

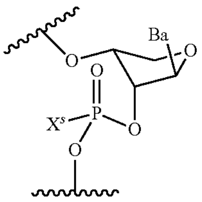

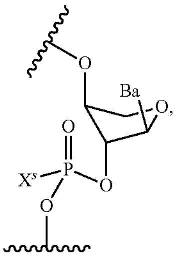
, wherein $X^s$ corresponds to the P-modification group "—XLR$^1$" described herein and Ba is as defined herein.

In some embodiments, a modified sugar is of any one in the following formulae:

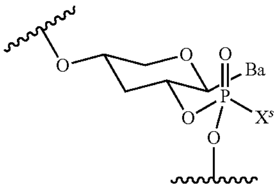

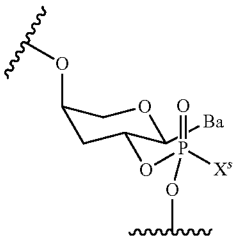

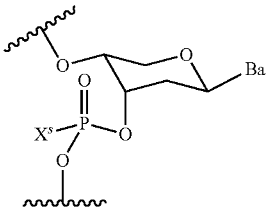

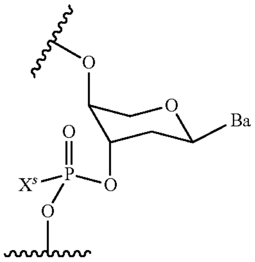

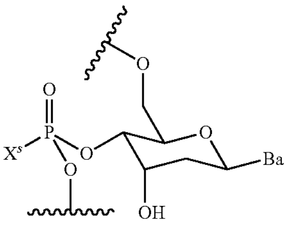

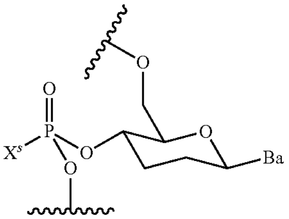

-continued

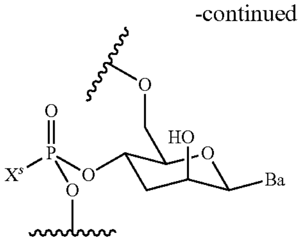

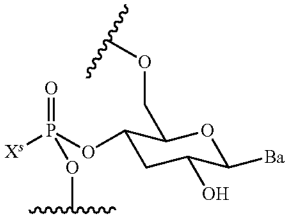

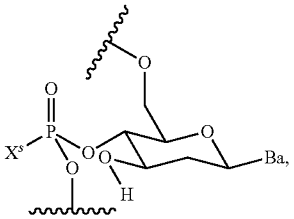
, wherein $X^s$ corresponds to the P-modification group "—XLR$^1$" described herein and Ba is as defined herein.

In some embodiments, one or more hydroxyl group in a sugar moiety is optionally and independently replaced with halogen, R'—N(R')$_2$, —OR', or —SR', wherein each R' is independently as defined above and described herein.

In some embodiments, a sugar mimetic is as illustrated below, wherein $X^s$ corresponds to the P-modification group "—XLR$^1$" described herein, Ba is as defined herein, and $X^1$ is selected from —S—, —Se—, —CH$_2$—, —NMe-, —NEt- or —NiPr—.

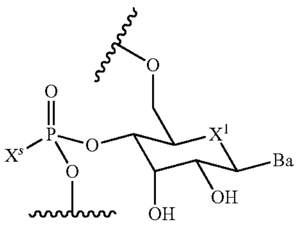

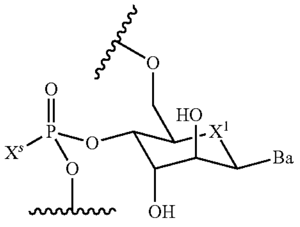

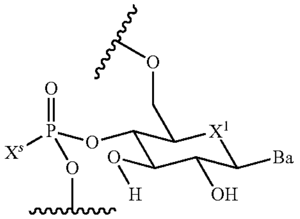

-continued
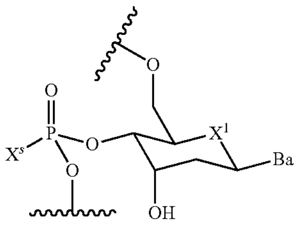
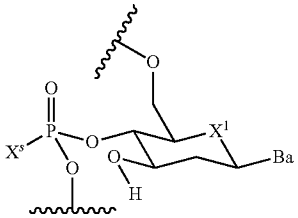
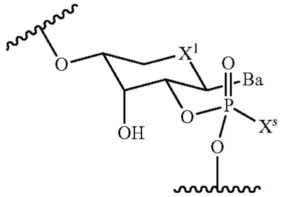
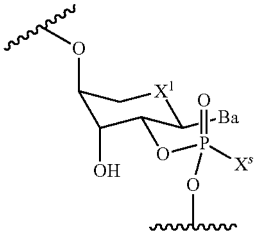
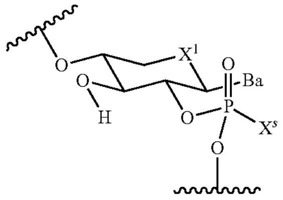
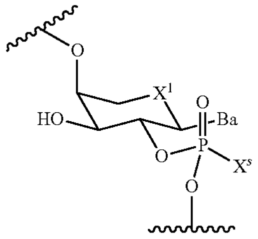
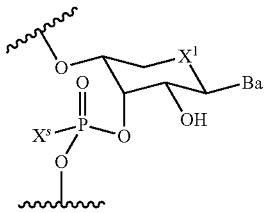
-continued
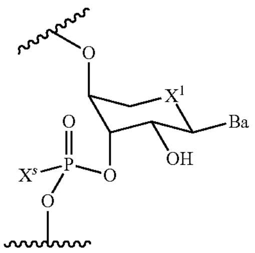
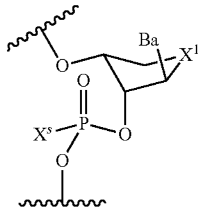
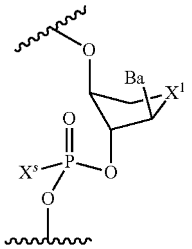
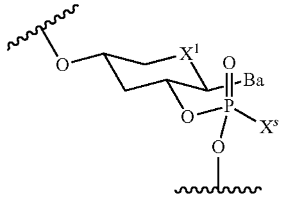
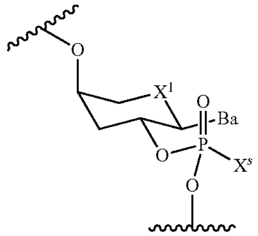
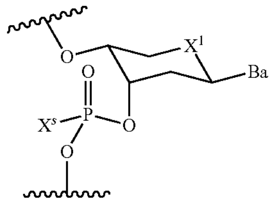
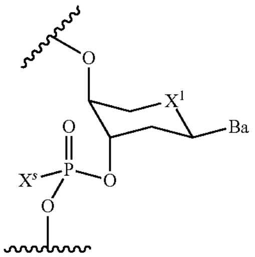
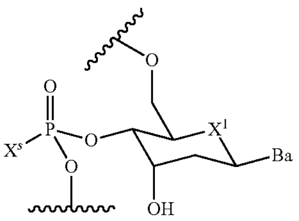

-continued

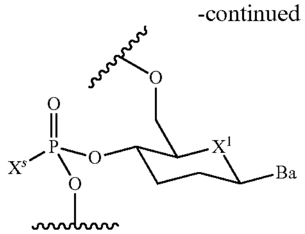

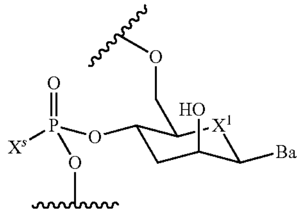

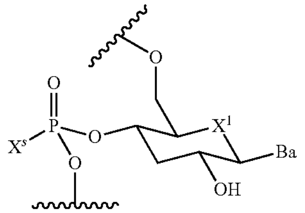

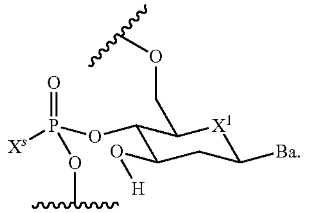

In some embodiments, at least 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24%, 25%, 26%, %, 36%, 37%, 38%, 39%, 40%, 41%, 42%, 27%, 28%, 29%, 30%, 31%, 32%, 33%, 34%, 35 43%, 44%, 45%, 46%, 47%, 48%, 49%, 50% or more (e.g., 55%, 60%, 65%, 70%, 75%, 80%, 85%, 90%, 95% or more), inclusive, of the sugars in a chirally controlled oligonucleotide composition are modified. In some embodiments, only purine residues are modified (e.g., about 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, % 48% 49% 50% or 35%, 36%, 37%, 38%, 39%, 40%, 41%, 42%, 43%, 44%, 45%, 46%, 47%, 48%, 49%, 50% or more [e.g., 55%, 60%, 65%, 70%, 75%, 80%, 85%, 90%, 95% or more] of the purine residues are modified). In some embodiments, only pyrimidine residues are modified (e.g., about 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50% or more [e.g., 55%, 60%, 65%, 70%, 75%, 80%, 85%, 90%, 95% or more] of the pyridimine residues are modified). In some embodiments, both purine and pyrimidine residues are modified.

Modified sugars and sugar mimetics can be prepared by methods known in the art, including, but not limited to: A. Eschenmoser, Science (1999), 284:2118; M. Bohringer et al, Helv. Chim. Acta (1992), 75:1416-1477; M. Egli et al, *J. Am. Chem. Soc.* (2006), 128(33):10847-56; A. Eschenmoser in *Chemical Synthesis: Gnosis to Prognosis*, C. Chatgilialoglu and V. Sniekus, Ed., (Kluwer Academic, Netherlands, 1996), p. 293; K.-U. Schoning et al, Science (2000), 290:1347-1351; A. Eschenmoser et al, Helv. Chim. Acta (1992), 75:218; J. Hunziker et al, Helv. Chim. Acta (1993), 76:259; G. Otting et al, Helv. Chim. Acta (1993), 76:2701; K. Groebke et al, Helv. Chim. Acta (1998), 81:375; and A. Eschenmoser, Science (1999), 284:2118. Modifications to the 2' modifications can be found in Verma, S. et al. *Annu. Rev. Biochem.* 1998, 67, 99-134 and all references therein. Specific modifications to the ribose can be found in the following references: 2'-fluoro (Kawasaki et. al., *J. Med. Chem.,* 1993, 36, 831-841), 2'-MOE (Martin, P. *Helv. Chim. Acta* 1996, 79, 1930-1938), "LNA" (Wengel, *J. Acc. Chem. Res.* 1999, 32, 301-310). In some embodiments, a modified sugar is any of those described in PCT Publication No. WO2012/030683, incorporated herein by reference, and/or depicted herein. In some embodiments, a modified sugar is any modified sugar described in any of: Gryaznov, S; Chen, J.-K. *J. Am. Chem. Soc.* 1994, 116, 3143; Hendrix et al. 1997 Chem. Eur. J. 3: 110; Hyrup et al. 1996 Bioorg. Med. Chem. 4: 5; Jepsen et al. 2004 Oligo. 14: 130-146; Jones et al. J. Org. Chem. 1993, 58, 2983; Koizumi et al. 2003 Nuc. Acids Res. 12: 3267-3273; Koshkin et al. 1998 Tetrahedron 54: 3607-3630; Kumar et al. 1998 Bioo. Med. Chem. Let. 8: 2219-2222; Lauritsen et al. 2002 Chem. Comm. 5: 530-531; Lauritsen et al. 2003 Bioo. Med. Chem. Lett. 13: 253-256; Mesmaeker et al. Angew. Chem., Int. Ed. Engl. 1994, 33, 226; Morita et al. 2001 Nucl. Acids Res. Supp. 1: 241-242; Morita et al. 2002 Bioo. Med. Chem. Lett. 12: 73-76; Morita et al. 2003 Bioo. Med. Chem. Lett. 2211-2226; Nielsen et al. 1997 Chem. Soc. Rev. 73; Nielsen et al. 1997 J. Chem. Soc. Perkins Transl. 1: 3423-3433; Obika et al. 1997 Tetrahedron Lett. 38 (50): 8735-8; Obika et al. 1998 Tetrahedron Lett. 39: 5401-5404; Pallan et al. 2012 Chem. Comm. 48: 8195-8197; Petersen et al. 2003 TRENDS Biotech. 21: 74-81; Rajwanshi et al. 1999 Chem. Commun. 1395-1396; Schultz et al. 1996 Nucleic Acids Res. 24: 2966; Seth et al. 2009 J. Med. Chem. 52: 10-13; Seth et al. 2010 J. Med. Chem. 53: 8309-8318; Seth et al. 2010 J. Org. Chem. 75: 1569-1581; Seth et al. 2012 Bioo. Med. Chem. Lett. 22: 296-299; Seth et al. 2012 Mol. Ther-Nuc. Acids. 1, e47; Seth, Punit P; Siwkowski, Andrew; Allerson, Charles R; Vasquez, Guillermo; Lee, Sam; Prakash, Thazha P; Kinberger, Garth; Migawa, Michael T; Gaus, Hans; Bhat, Balkrishen; et al. From Nucleic Acids Symposium Series (2008), 52(1), 553-554; Singh et al. 1998 Chem. Comm. 1247-1248; Singh et al. 1998 J. Org. Chem. 63: 10035-39; Singh et al. 1998 J. Org. Chem. 63: 6078-6079; Sorensen 2003 Chem. Comm. 2130-2131; Ts'o et al. Ann. N. Y. Acad. Sci. 1988, 507, 220; Van Aerschot et al. 1995 Angew. Chem. Int. Ed. Engl. 34: 1338; Vasseur et al. *J. Am. Chem. Soc.* 1992, 114, 4006; WO 20070900071; WO 20070900071; or WO 2016/079181.

In some embodiments, a modified sugar moiety is an optionally substituted pentose or hexose moiety. In some embodiments, a modified sugar moiety is an optionally substituted pentose moiety. In some embodiments, a modified sugar moiety is an optionally substituted hexose moiety. In some embodiments, a modified sugar moiety is an optionally substituted ribose or hexitol moiety. In some embodiments, a modified sugar moiety is an optionally substituted ribose moiety. In some embodiments, a modified sugar moiety is an optionally substituted hexitol moiety.

In some embodiments, an example modified internucleotidic linkage and/or sugar is selected from, e.g., those in:

-continued
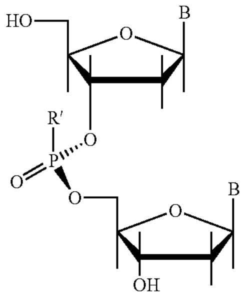
S
R' = —OC$_2$H
R' = —CH$_3$
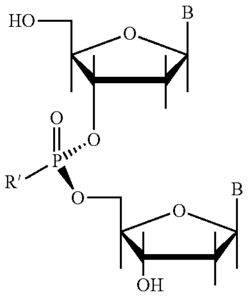
R
Np(Et)N
NpN
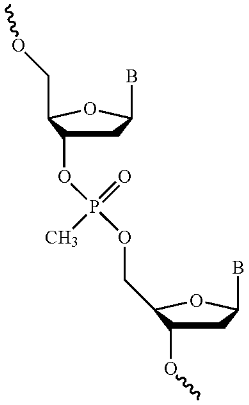
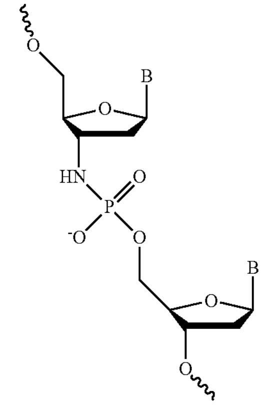
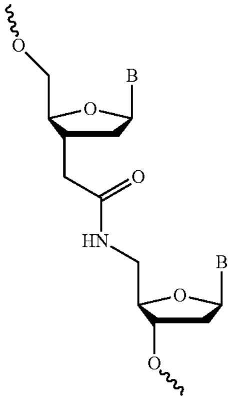
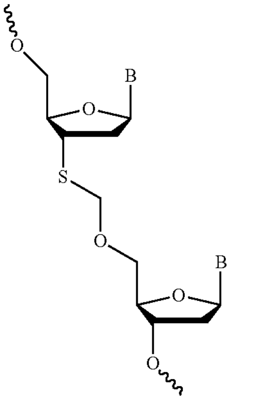
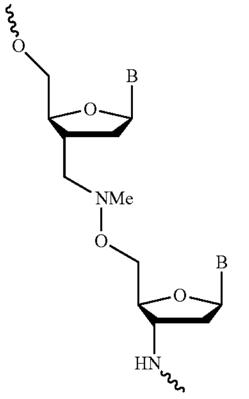
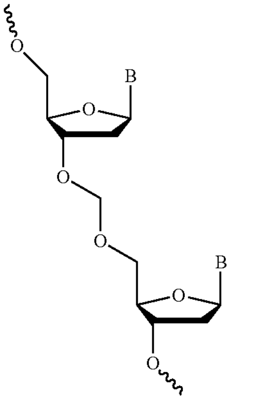
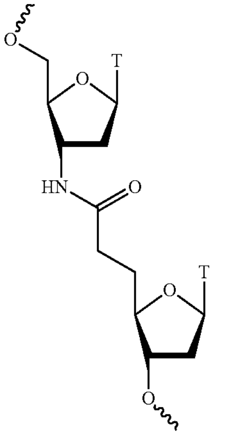
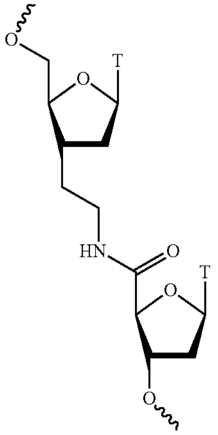
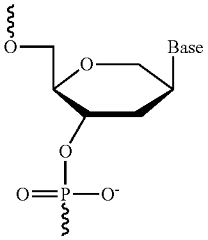
HNA
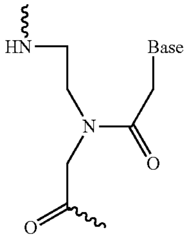
PNA
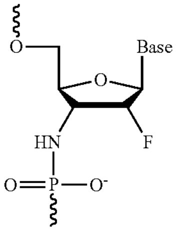
2'-Fluoro N3'-P5'-phosphoramidate
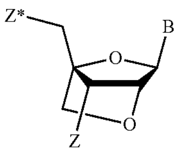
LNA
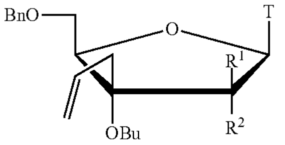
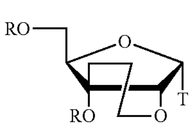
beta-D-oxy-LNA
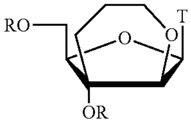
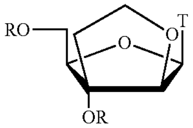
2'-O,3'-C-linked bicyclic
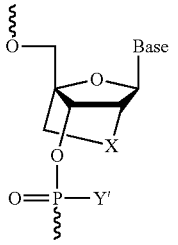
| | |
|---|---|
| LNA: | X = O, Y = O |
| 2'-Thio-LNA: | X = S, Y = O |
| 2'-Phosphorothioate-LNA: | X = O, Y = S |

-continued

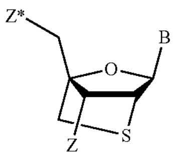

PS-LNA

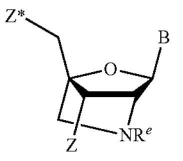

beta-D-thio-LNA

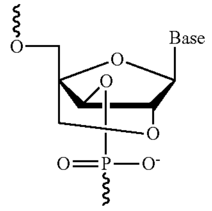

beta-D-amino-LNA

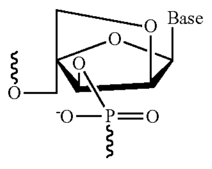

xylo-LNA [c]

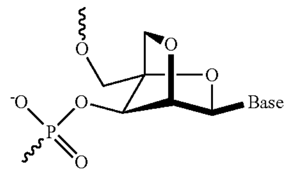

alpha-L-LNA

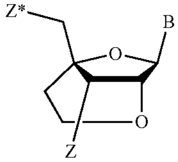

ENA

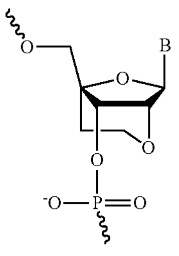

beta-D-ENA

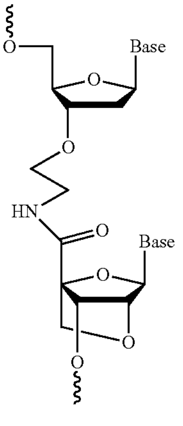

amide-linked LNA

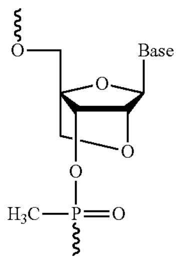

methylphosphonate-LNA

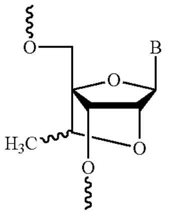

(R,S)-cEt

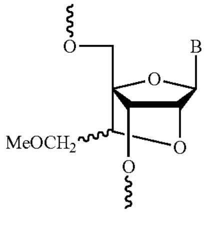

(R,S)-cMOE
(R,S)-cMOE

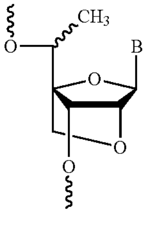

(R,S)-5′-Me-LNA

-continued

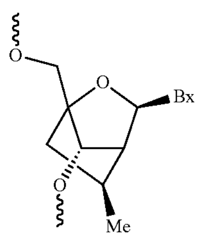

S—Me cLNA

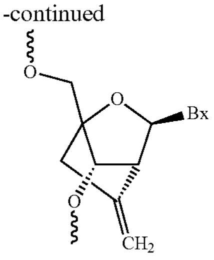

Methylene-cLNA

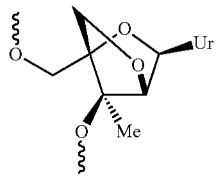

3′-Me-alpha-L-LNA

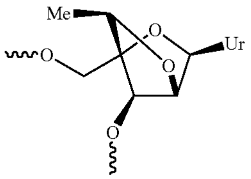

R-6′-Me-alpha-L-LNA

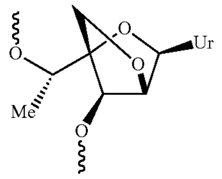

S-5′-Me-alpha-L-LNA

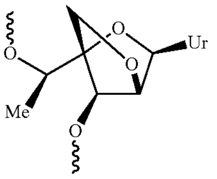

R-5′-Me-alpha-L-LNA

In some embodiments, $R^1$ is R as defined and described. In some embodiments, $R^2$ is R. In some embodiments, $R^e$ is R. In some embodiments, $R^e$ is H, $CH_3$, Bn, $COCF_3$, benzoyl, benzyl, pyren-1-ylcarbonyl, pyren-1-ylmethyl, 2-aminoethyl. In some embodiments, an example modified internucleotidic linkage and/or sugar is selected from those described in Ts'o et al. Ann. N. Y. Acad. Sci. 1988, 507, 220; Gryaznov, S.; Chen, J.-K. J. Am. Chem. Soc. 1994, 116, 3143; Mesmaeker et al. Angew. Chem., Int. Ed. Engl. 9, 33, 226; Jones et al. J. Org. Chem. 9, 58, 2983; Vasseur et al. J. Am. Chem. Soc. 1992, 114, 4006; Van Aerschot et al. 1995 Angew. Chem. Int. Ed. Engl. 34: 1338; Hendrix et al. 1997 Chem. Eur. J. 3: 110; Koshkin et al. 1998 Tetrahedron 54: 3607-3630; Hyrup et al. 1996 Bioorg. Med. Chem. 4: 5; Nielsen et al. 1997 Chem. Soc. Rev. 73; Schultz et al. 1996 Nucleic Acids Res. 24: 2966; Obika et al. 1997 Tetrahedron Lett. 38 (50): 8735-8; Obika et al. 1998 Tetrahedron Lett. 39: 5401-5404; Singh et al. 1998 Chem. Comm. 1247-1248; Kumar et al. 1998 Bioo. Med. Chem. Let. 8: 2219-2222; Nielsen et al. 1997 J. Chem. Soc. Perkins Transl. 1: 3423-3433; Singh et al. 1998 J. Org. Chem. 63: 6078-6079; Seth et al. 2010 J. Org. Chem. 75: 1569-1581; Singh et al. 1998 J. Org. Chem. 63: 10035-39; Sorensen 2003 Chem. Comm. 2130-2131; Petersen et al. 2003 TRENDS Biotech. 21: 74-81; Rajwanshi et al. 1999 Chem. Commun. 1395-1396; Jepsen et al. 2004 Oligo. 14: 130-146; Morita et al. 2001 Nucl. Acids Res. Supp. 1: 241-242; Morita et al. 2002 Bioo. Med. Chem. Lett. 12: 73-76; Morita et al. 2003 Bioo. Med. Chem. Lett. 2211-2226; Koizumi et al. 2003 Nuc. Acids Res. 12: 3267-3273; Lauritsen et al. 2002 Chem. Comm. 5: 530-531; Lauritsen et al. 2003 Bioo. Med. Chem. Lett. 13: 253-256; WO 20070900071; Seth et al., Nucleic Acids Symposium Series (2008), 52(1), 553-554; Seth et al. 2009 J. Med. Chem. 52: 10-13; Seth et al. 2012 Mol. Ther-Nuc. Acids. 1, e47; Pallan et al. 2012 Chem. Comm. 48: 8195-8197; Seth et al. 2010 J. Med. Chem. 53: 8309-8318; Seth et al. 2012 Bioo. Med. Chem. Lett. 22: 296-299; WO 2016/079181; U.S. Pat. Nos. 6,326,199; 6,066,500; and 6,440,739, the base and sugar modifications of each of which is herein incorporated by reference.

Oligonucleotides

In some embodiments, the present disclosure provides oligonucleotides and oligonucleotide compositions that are chirally controlled. For instance, in some embodiments, a provided composition contains predetermined levels of one or more individual oligonucleotide types, wherein an oligonucleotide type is defined by: 1) base sequence; 2) pattern of backbone linkages; 3) pattern of backbone chiral centers; and 4) pattern of backbone P-modifications. In some embodiments, a particular oligonucleotide type may be defined by 1A) base identity; 1B) pattern of base modification; 1C) pattern of sugar modification; 2) pattern of backbone linkages; 3) pattern of backbone chiral centers; and 4) pattern of backbone P-modifications. In some embodiments, oligonucleotides of the same oligonucleotide type are identical.

In some embodiments, a provided oligonucleotide is a unimer. In some embodiments, a provided oligonucleotide is a P-modification unimer. In some embodiments, a provided oligonucleotide is a stereounimer. In some embodiments, a provided oligonucleotide is a stereounimer of configuration Rp. In some embodiments, a provided oligonucleotide is a stereounimer of configuration Sp.

In some embodiments, a provided oligonucleotide is an altmer. In some embodiments, a provided oligonucleotide is a P-modification altmer. In some embodiments, a provided oligonucleotide is a stereoaltmer.

In some embodiments, a provided oligonucleotide is a blockmer. In some embodiments, a provided oligonucleotide is a P-modification blockmer. In some embodiments, a provided oligonucleotide is a stereoblockmer.

In some embodiments, a provided oligonucleotide is a gapmer.

In some embodiments, a provided oligonucleotide is a skipmer.

In some embodiments, a provided oligonucleotide is a hemimer. In some embodiments, a hemimer is an oligonucleotide wherein the 5'-end or the 3'-end has a sequence that possesses a structure feature that the rest of the oligonucleotide does not have. In some embodiments, the 5'-end or the 3'-end has or comprises 2 to 20 nucleotides. In some embodiments, a structural feature is a base modification. In some embodiments, a structural feature is a sugar modification. In some embodiments, a structural feature is a P-modification. In some embodiments, a structural feature is stereochemistry of the chiral internucleotidic linkage. In some embodiments, a structural feature is or comprises a base modification, a sugar modification, a P-modification, or stereochemistry of the chiral internucleotidic linkage, or combinations thereof. In some embodiments, a hemimer is an oligonucleotide in which each sugar moiety of the 5'-end sequence shares a common modification. In some embodiments, a hemimer is an oligonucleotide in which each sugar moiety of the 3'-end sequence shares a common modification. In some embodiments, a common sugar modification of the 5' or 3' end sequence is not shared by any other sugar moieties in the oligonucleotide. In some embodiments, an example hemimer is an oligonucleotide comprising a sequence of substituted or unsubstituted 2'-O-alkyl sugar modified nucleosides, bicyclic sugar modified nucleosides, β-D-ribonucleosides or β-D-deoxyribonucleosides (for example 2'-MOE modified nucleosides, and LNA™ or ENA™ bicyclic sugar modified nucleosides) at one terminus and a sequence of nucleosides with a different sugar moiety (such as a substituted or unsubstituted 2'-O-alkyl sugar modified nucleosides, bicyclic sugar modified nucleosides or natural ones) at the other terminus. In some embodiments, a provided oligonucleotide is a combination of one or more of unimer, altmer, blockmer, gapmer, hemimer and skipmer. In some embodiments, a provided oligonucleotide is a combination of one or more of unimer, altmer, blockmer, gapmer, and skipmer. For instance, in some embodiments, a provided oligonucleotide is both an altmer and a gapmer. In some embodiments, a provided nucleotide is both a gapmer and a skipmer. One of skill in the chemical and synthetic arts will recognize that numerous other combinations of patterns are available and are limited only by the commercial availability and/or synthetic accessibility of constituent parts required to synthesize a provided oligonucleotide in accordance with methods of the present disclosure. In some embodiments, a hemimer structure provides advantageous benefits. In some embodiments, provided oligonucleotides are 5'-hemmimers that comprises modified sugar moieties in a 5'-end sequence. In some embodiments, provided oligonucleotides are 5'-hemmimers that comprises modified 2'-sugar moieties in a 5'-end sequence.

In some embodiments, a provided oligonucleotide comprises one or more optionally substituted nucleotides. In some embodiments, a provided oligonucleotide comprises one or more modified nucleotides. In some embodiments, a provided oligonucleotide comprises one or more optionally substituted nucleosides. In some embodiments, a provided oligonucleotide comprises one or more modified nucleosides. In some embodiments, a provided oligonucleotide comprises one or more optionally substituted LNAs.

In some embodiments, a provided oligonucleotide comprises one or more optionally substituted nucleobases. In some embodiments, a provided oligonucleotide comprises one or more optionally substituted natural nucleobases. In some embodiments, a provided oligonucleotide comprises one or more optionally substituted modified nucleobases. In some embodiments, a provided oligonucleotide comprises one or more 5-methylcytidine; 5-hydroxymethylcytidine, 5-formylcytosine, or 5-carboxylcytosine. In some embodiments, a provided oligonucleotide comprises one or more 5-methylcytidine.

In some embodiments, a provided oligonucleotide comprises one or more optionally substituted sugars. In some embodiments, a provided oligonucleotide comprises one or more optionally substituted sugars found in naturally occurring DNA and RNA. In some embodiments, a provided oligonucleotide comprises one or more optionally substituted ribose or deoxyribose. In some embodiments, a provided oligonucleotide comprises one or more optionally substituted ribose or deoxyribose, wherein one or more hydroxyl groups of the ribose or deoxyribose moiety is optionally and independently replaced by halogen, R', $—N(R')_2$, —OR', or —SR', wherein each R' is independently as defined above and described herein. In some embodiments, a provided oligonucleotide comprises one or more optionally substituted deoxyribose, wherein the 2' position of the deoxyribose is optionally and independently substituted with halogen, R', $—N(R')_2$, —OR', or —SR', wherein each R' is independently as defined above and described herein. In some embodiments, a provided oligonucleotide comprises one or more optionally substituted deoxyribose, wherein the 2' position of the deoxyribose is optionally and independently substituted with halogen. In some embodiments, a provided oligonucleotide comprises one or more optionally substituted deoxyribose, wherein the 2' position of the deoxyribose is optionally and independently substituted with one or more —F. halogen. In some embodiments, a provided oligonucleotide comprises one or more optionally substituted deoxyribose, wherein the 2' position of the deoxyribose is optionally and independently substituted with —OR', wherein each R' is independently as defined above and described herein. In some embodiments, a provided oligonucleotide comprises one or more optionally substituted deoxyribose, wherein the 2' position of the deoxyribose is optionally and independently substituted with —OR', wherein each R' is independently an optionally substituted $C_1$-$C_6$ aliphatic. In some embodiments, a provided oligonucleotide comprises one or more optionally substituted deoxyribose, wherein the 2' position of the deoxyribose is optionally and independently substituted with —OR', wherein each R' is independently an optionally substituted $C_1$-$C_6$ alkyl. In some embodiments, a provided oligonucleotide comprises one or more optionally substituted deoxyribose, wherein the 2' position of the deoxyribose is optionally and independently substituted with —OMe. In some embodiments, a provided oligonucleotide comprises one or more optionally substituted deoxyribose, wherein the 2' position of the deoxyribose is optionally and independently substituted with —O-methoxyethyl.

In some embodiments, a provided oligonucleotide is single-stranded oligonucleotide.

In some embodiments, a provided oligonucleotide is a hybridized oligonucleotide strand. In certain embodiments, a provided oligonucleotide is a partially hybridized oligonucleotide strand. In certain embodiments, a provided oligonucleotide is a completely hybridized oligonucleotide strand. In certain embodiments, a provided oligonucleotide is a double-stranded oligonucleotide. In certain embodiments, a provided oligonucleotide is a triple-stranded oligonucleotide (e.g., a triplex).

In some embodiments, a provided oligonucleotide is chimeric. For example, in some embodiments, a provided oligonucleotide is DNA-RNA chimera, DNA-LNA chimera, etc.

In some embodiments, any one of the structures comprising an oligonucleotide depicted in WO2012/030683 can be modified in accordance with methods of the present disclosure to provide chirally controlled variants thereof. For example, in some embodiments the chirally controlled variants comprise a stereochemical modification at any one or more of the linkage phosphorus and/or a P-modification at any one or more of the linkage phosphorus. For example, in some embodiments, a particular nucleotide unit of an oligonucleotide of WO2012/030683 is preselected to be stereochemically modified at the linkage phosphorus of that nucleotide unit and/or P-modified at the linkage phosphorus of that nucleotide unit. In some embodiments, a chirally controlled oligonucleotide is of any one of the structures depicted in the Figures. In some embodiments, a chirally controlled oligonucleotide is a variant (e.g., modified version) of any one of the structures depicted in the Figures. The related disclosure of WO2012/030683 is herein incorporated by reference in its entirety.

In some embodiments, a provided oligonucleotide is a therapeutic agent.

In some embodiments, a provided oligonucleotide is an antisense oligonucleotide.

In some embodiments, a provided oligonucleotide is an antigene oligonucleotide.

In some embodiments, a provided oligonucleotide is a decoy oligonucleotide.

In some embodiments, a provided oligonucleotide is part of a DNA vaccine.

In some embodiments, a provided oligonucleotide is an immunomodulatory oligonucleotide, e.g., immunostimulatory oligonucleotide and immunoinhibitory oligonucleotide.

In some embodiments, a provided oligonucleotide is an adjuvant.

In some embodiments, a provided oligonucleotide is an aptamer.

In some embodiments, a provided oligonucleotide is a ribozyme.

In some embodiments, a provided oligonucleotide is a deoxyribozyme (DNAzymes or DNA enzymes).

In some embodiments, a provided oligonucleotide is an siRNA.

In some embodiments, a provided oligonucleotide is a microRNA, or miRNA.

In some embodiments, a provided oligonucleotide is a ncRNA (non-coding RNAs), including a long non-coding RNA (lncRNA) and a small non-coding RNA, such as piwi-interacting RNA (piRNA).

In some embodiments, a provided oligonucleotide is complementary to a structural RNA, e.g., tRNA.

In some embodiments, a provided oligonucleotide is a nucleic acid analog, e.g., GNA, LNA, PNA, TNA and Morpholino.

In some embodiments, a provided oligonucleotide is a P-modified prodrug.

In some embodiments, a provided oligonucleotide is a primer. In some embodiments, a primers is for use in polymerase-based chain reactions (i.e., PCR) to amplify nucleic acids. In some embodiments, a primer is for use in any known variations of PCR, such as reverse transcription PCR (RT-PCR) and real-time PCR.

In some embodiments, a provided oligonucleotide is characterized as having the ability to modulate RNase H activation. For example, in some embodiments, RNase H activation is modulated by the presence of stereocontrolled phosphorothioate nucleic acid analogs, with natural DNA/RNA being more or equally susceptible than the Rp stereoisomer, which in turn is more susceptible than the corresponding Sp stereoisomer.

In some embodiments, a provided oligonucleotide is characterized as having the ability to indirectly or directly increase or decrease activity of a protein or inhibition or promotion of the expression of a protein. In some embodiments, a provided oligonucleotide is characterized in that it is useful in the control of cell proliferation, viral replication, and/or any other cell signaling process.

In some embodiments, a provided oligonucleotide is from about 2 to about 200 nucleotide units in length. In some embodiments, a provided oligonucleotide is from about 2 to about 180 nucleotide units in length. In some embodiments, a provided oligonucleotide is from about 2 to about 160 nucleotide units in length. In some embodiments, a provided oligonucleotide is from about 2 to about 140 nucleotide units in length. In some embodiments, a provided oligonucleotide is from about 2 to about 120 nucleotide units in length. In some embodiments, a provided oligonucleotide is from about 2 to about 100 nucleotide units in length. In some embodiments, a provided oligonucleotide is from about 2 to about 90 nucleotide units in length. In some embodiments, a provided oligonucleotide is from about 2 to about 80 nucleotide units in length. In some embodiments, a provided oligonucleotide is from about 2 to about 70 nucleotide units in length. In some embodiments, a provided oligonucleotide is from about 2 to about 60 nucleotide units in length. In some embodiments, a provided oligonucleotide is from about 2 to about 50 nucleotide units in length. In some embodiments, a provided oligonucleotide is from about 2 to about 40 nucleotide units in length. In some embodiments, a provided oligonucleotide is from about 2 to about 30 nucleotide units in length. In some embodiments, a provided oligonucleotide is from about 2 to about 29 nucleotide units in length. In some embodiments, a provided oligonucleotide is from about 2 to about 28 nucleotide units in length. In some embodiments, a provided oligonucleotide is from about 2 to about 27 nucleotide units in length. In some embodiments, a provided oligonucleotide is from about 2 to about 26 nucleotide units in length. In some embodiments, a provided oligonucleotide is from about 2 to about 25 nucleotide units in length. In some embodiments, a provided oligonucleotide is from about 2 to about 24 nucleotide units in length. In some embodiments, a provided oligonucleotide is from about 2 to about 23 nucleotide units in length. In some embodiments, a provided oligonucleotide is from about 2 to about 22 nucleotide units in length. In some embodiments, a provided oligonucleotide is from about 2 to about 21 nucleotide units in length. In some embodiments, a provided oligonucleotide is from about 2 to about 20 nucleotide units in length.

In some embodiments, a provided oligonucleotide is from about 4 to about 200 nucleotide units in length. In some embodiments, a provided oligonucleotide is from about 4 to about 180 nucleotide units in length. In some embodiments, a provided oligonucleotide is from about 4 to about 160 nucleotide units in length. In some embodiments, a provided oligonucleotide is from about 4 to about 140 nucleotide units in length. In some embodiments, a provided oligonucleotide is from about 4 to about 120 nucleotide units in length. In some embodiments, a provided oligonucleotide is from about 4 to about 100 nucleotide units in length. In some embodiments, a provided oligonucleotide is from about 4 to about 90 nucleotide units in length. In some embodiments, a provided oligonucleotide is from about 4 to about 80 nucleotide units in length. In some embodiments, a provided oligonucleotide is from about 4 to about 70 nucleotide units in length. In some embodiments, a provided oligonucleotide is from about 4 to about 60 nucleotide units in length. In some embodiments, a provided oligonucleotide is from about 4 to about 50 nucleotide units in length. In some embodiments, a provided oligonucleotide is from about 4 to about 40 nucleotide units in length. In some embodiments, a provided oligonucleotide is from about 4 to about 30 nucleotide units in length. In some embodiments, a provided oligonucleotide is from about 4 to about 29 nucleotide units in length. In some embodiments, a provided oligonucleotide is from about 4 to about 28 nucleotide units in length. In some embodiments, a provided oligonucleotide is from about 4 to about 27 nucleotide units in length. In some embodiments, a provided oligonucleotide is from about 4 to about 26 nucleotide units in length. In some embodiments, a provided oligonucleotide is from about 4 to about 25 nucleotide units in length. In some embodiments, a provided oligonucleotide is from about 4 to about 24 nucleotide units in length. In some embodiments, a provided oligonucleotide is from about 4 to about 23 nucleotide units in length. In some embodiments, a provided oligonucleotide is from about 4 to about 22 nucleotide units in length. In some embodiments, a provided oligonucleotide is from about 4 to about 21 nucleotide units in length. In some embodiments, a provided oligonucleotide is from about 4 to about 20 nucleotide units in length.

In some embodiments, a provided oligonucleotide is from about 5 to about 10 nucleotide units in length. In some embodiments, a provided oligonucleotide is from about 10 to about 30 nucleotide units in length. In some embodiments, a provided oligonucleotide is from about 15 to about 25 nucleotide units in length. In some embodiments, a provided oligonucleotide is from about 5, 6, 7, 8, 9, 10, 11, 12, 13, 14, 15, 16, 17, 18, 19, 20, 21, 22, 23, 24, or 25 nucleotide units in length.

In some embodiments, an oligonucleotide is at least 2 nucleotide units in length. In some embodiments, an oligonucleotide is at least 3 nucleotide units in length. In some embodiments, an oligonucleotide is at least 4 nucleotide units in length. In some embodiments, an oligonucleotide is at least 5 nucleotide units in length. In some embodiments, an oligonucleotide is at least 6 nucleotide units in length. In some embodiments, an oligonucleotide is at least 7 nucleotide units in length. In some embodiments, an oligonucleotide is at least 8 nucleotide units in length. In some embodiments, an oligonucleotide is at least 9 nucleotide units in length. In some embodiments, an oligonucleotide is at least 10 nucleotide units in length. In some embodiments, an oligonucleotide is at least 11 nucleotide units in length. In some embodiments, an oligonucleotide is at least 12 nucleotide units in length. In some embodiments, an oligonucleotide is at least 13 nucleotide units in length. In some embodiments, an oligonucleotide is at least 14 nucleotide units in length. In some embodiments, an oligonucleotide is at least 15 nucleotide units in length. In some embodiments, an oligonucleotide is at least 16 nucleotide units in length. In some embodiments, an oligonucleotide is at least 17 nucleotide units in length. In some embodiments, an oligonucleotide is at least 18 nucleotide units in length. In some embodiments, an oligonucleotide is at least 19 nucleotide units in length. In some embodiments, an oligonucleotide is at least 20 nucleotide units in length. In some embodiments, an oligonucleotide is at least 21 nucleotide units in length. In some embodiments, an oligonucleotide is at least 22 nucleotide units in length. In some embodiments, an oligonucleotide is at least 23 nucleotide units in length. In some embodiments, an oligonucleotide is at least 24 nucleotide units in length. In some embodiments, an oligonucleotide is at least 25 nucleotide units in length. In some other embodiments, an oligonucleotide is at least 30 nucleotide units in length. In some other embodiments, an oligonucleotide is a duplex of complementary strands of at least 18 nucleotide units in length. In some other embodiments, an oligonucleotide is a duplex of complementary strands of at least 21 nucleotide units in length.

In some embodiments, the 5'-end and/or the 3'-end of a provided oligonucleotide is modified. In some embodiments, the 5'-end and/or the 3'-end of a provided oligonucleotide is modified with a terminal cap moiety. Examples of such modifications, including terminal cap moieties are extensively described herein and in the art, for example but not limited to those described in US Patent Application Publication US 2009/0023675A1.

In some embodiments, oligonucleotides of an oligonucleotide type characterized by 1) a common base sequence and length, 2) a common pattern of backbone linkages, and 3) a common pattern of backbone chiral centers, have the same chemical structure. For example, they have the same base sequence, the same pattern of nucleoside modifications, the same pattern of backbone linkages (i.e., pattern of internucleotidic linkage types, for example, phosphate, phosphorothioate, etc), the same pattern of backbone chiral centers (i.e. pattern of linkage phosphorus stereochemistry (Rp/Sp)), and the same pattern of backbone phosphorus modifications (e.g., pattern of "—XLR[1]" groups in formula I).

Example Oligonucleotides and Compositions

In some embodiments, the present disclosure provides oligonucleotides and/or oligonucleotide compositions that are useful for various purposes known in the art. In some embodiments, the present disclosure provides oligonucleotide compositions with improved properties, e.g., activities, toxicities, etc. Non-limiting example compositions are listed below:

TABLE 2A

Example Oligonucleotide and Compositions

| | | SEQ ID NO. |
|---|---|---|
| WV-459 | m5C*m5C*G*T*m5C*G*m5C*m5C*m5C*T*T*m5C*A*G*m5C*A*m5C*G*m5C*A | 35 |
| WV-485 | m5C*Sm5C*SG*ST*Sm5C*SG*Sm5C*Sm5C*Sm5C*ST*ST*Sm5C*RA*SG*Sm5C*SA*Sm5C*SG*Sm5C*SA | 36 |
| WV-458 | m5Ceo*m5Ceo*Geo*Teo*m5Ceo*G*m5C*m5C*m5C*T*T*m5C*A*G*m5C*Aeo*m5Ceo*Geo*m5Ceo*Aeo | 37 |
| WV-486 | m5Ceo*Sm5Ceo*SGeo*STeo*Sm5Ceo*SG*Sm5C*Sm5C*Sm5C*ST*ST*Sm5C*SA*SG*Sm5C*SAeo*Sm5Ceo*SGeo*Sm5Ceo*SAeo | 38 |
| WV-487 | m5Ceo*Sm5Ceo*SGeo*STeo*Sm5Ceo*SG*Sm5C*Sm5C*Sm5C*ST*ST*Sm5C*RA*SG*Sm5C*SAeo*Sm5Ceo*SGeo*Sm5Ceo*SAeo | 39 |
| WV-488 | m5Ceo*Rm5Ceo*RGeo*RTeo*Rm5Ceo*RG*Sm5C*Sm5C*Sm5C*ST*ST*Sm5C*RA*SG*Sm5C*SAeo*Rm5Ceo*RGeo*Rm5Ceo*RAeo | 40 |
| ONT-83 | Geo*Teo*m5Ceo*m5Ceo*m5Ceo*T*G*A*A*G*A*T*G*T*m5C*Aeo*Aeo*Teo*Geo*m5Ceo | 41 |
| ONT-82 | Geo*RTeo*Rm5Ceo*Rm5Ceo*Rm5Ceo*RT*RG*RA*RA*RG*RA*RT*RG*RT*Rm5C*RAeo*RAeo*RTeo*RGeo*Rm5Ceo | 42 |
| ONT-84 | Geo*STeo*Sm5Ceo*Sm5Ceo*Sm5Ceo*ST*SG*SA*SA*SG*SA*ST*SG*ST*Sm5C*SAeo*SAeo*STeo*SGeo*Sm5Ceo | 43 |
| ONT-85 | Geo*RTeo*Rm5Ceo*Rm5Ceo*Rm5Ceo*RT*SG*SA*SA*SG*SA*ST*SG*ST*Sm5C*SAeo*RAeo*RTeo*RGeo*Rm5Ceo | 44 |
| ONT-86 | Geo*STeo*Sm5Ceo*Sm5Ceo*Sm5Ceo*ST*RG*RA*RA*RG*RA*RT*RG*RT*Rm5C*RAeo*SAeo*STeo*SGeo*Sm5Ceo | 45 |
| WV-917 | mG*mG*mC*mA*mC*A*A*G*G*G*C*A*C*A*G*mA*mC*mU*mU*mC | 46 |
| WV-1085 | mG*SmG*SmC*SmA*SmC*SA*SA*SG*SG*SG*SC*SA*SC*RA*SG*SmA*SmC*SmU*SmU*SmC | 47 |
| WV-1086 | mG*RmG*RmC*RmA*RmC*SA*SA*SG*SG*SG*SC*SA*SC*RA*SG*SmA*RmC*RmU*RmU*RmC | 48 |
| WV-1087 | mGmGmCmAmC*SA*SA*SG*SG*SG*SC*SA*SC*RA*SG*SmAmCmUmUmC | 49 |
| WV-1091 | mG*RmGmCmAmC*SA*SA*SG*SG*SG*SC*SA*SC*RA*SG*SmAmCmUmU*RmC | 50 |
| WV-1092 | mG*SmGmCmAmC*SA*SA*SG*SG*SG*SC*SA*SC*RA*SG*SmAmCmUmU*SmC | 6 |
| WV-1510 | G*SmGmCmAmC*SA*SA*SG*SG*SG*SC*SA*SC*RA*SG*SmAmCmUmU*SC | 51 |
| WV-1511 | G*mGmCmAmC*A*A*G*G*G*C*A*C*A*G*mAmCmUmU*C | 52 |

TABLE 2A-continued

| Example Oligonucleotide and Compositions | | SEQ ID NO. |
|---|---|---|
| WV-1497 | mG*mGmCmAmC*A*A*G*G*G*C*A*C*A*G*mAmCmUmU*mC | 7 |
| WV-1655 | Geo*Geom5CeoAeom5Ceo*A*A*G*G*G*C*A*C*A*G*Aeom5Ceo TeoTeo*m5Ceo | 53 |

TABLE 3A

| | Brief Description of Example Oligonucleotides and Compositions. |
|---|---|
| WV-459 | All DNA, each cytidine is 5-methylated, Stereorandom |
| WV-485 | All DNA, each cytidine is 5-methylated, Stereopure, One Rp in DNA |
| WV-458 | 5-10-5 (2'-MOE-DNA-2'-MOE) Gapmer, each cytidine is 5-methylated, Stereorandom |
| WV-486 | 5-10-5 (2'-MOE-DNA-2'-MOE) Gapmer, each cytidine is 5-methylated, Stereopure |
| WV-487 | 5-10-5 (2'-MOE-DNA-2'-MOE) Gapmer, each cytidine is 5-methylated, Stereopure, One Rp in DNA |
| WV-488 | 5-10-5 (2'-MOE-DNA-2'-MOE) Gapmer, each cytidine is 5-methylated, Stereopure, One Rp in DNA and Rp wings |
| ONT-83 | 5-10-5 (2'-MOE-DNA-2'-MOE) Gapmer, each cytidine is 5-methylated, Stereorandom |
| ONT-82 | 5-10-5 (2'-MOE-DNA-2'-MOE) Gapmer, each cytidine is 5-methylated, Stereopure |
| ONT-84 | 5-10-5 (2'-MOE-DNA-2'-MOE) Gapmer, each cytidine is 5-methylated, Stereopure |
| ONT-85 | 5-10-5 (2'-MOE-DNA-2'-MOE) Gapmer, each cytidine is 5-methylated, Rp wings |
| ONT-86 | 5-10-5 (2'-MOE-DNA-2'-MOE) Gapmer, each cytidine is 5-methylated, Sp wings |
| WV-917 | 5-10-5 (2'-OMe-DNA-2'-OMe), Gapmer, Stereorandom |
| WV-1085 | 5-10-5 (2'-OMe-DNA-2'-OMe) Gapmer, Stereopure, One Rp in DNA |
| WV-1086 | 5-10-5 (2'-OMe-DNA-2'-OMe) Gapmer, Stereopure, One Rp in DNA and Rp wings |
| WV-1087 | 5-10-5 (2'-OMe-DNA-2'-OMe) Gapmer, Stereopure, One Rp in DNA, PO wings |
| WV-1091 | 5-10-5 (2'-OMe-DNA-2'-OMe) Gapmer, Stereopure, One Rp in DNA, PO wings with One Rp on each end |
| WV-1092 | 5-10-5 (2'-OMe-DNA-2'-OMe) Gapmer, Stereopure, One Rp in DNA, PO wings with One Sp on each end |
| WV-1510 | 1-4-10-4-1 (DNA-2'-OMe-DNA-2'-OMe-DNA) Gapmer, Stereopure, One Rp in DNA, PO wings with One Sp on each end |
| WV-1511 | 1-4-10-4-1 (DNA-2'-OMe-DNA-2'-OMe-DNA) Gapmer, Stereorandom |
| WV-1497 | 5-10-5 (2'-OMe-DNA-2'-OMe) Gapmer, Stereorandom, PO wings with One PS on each end |
| WV-1655 | 5-10-5 (2'-MOE-DNA-2'-MOE) Gapmer, Stereorandom, PO wings with One PS on each end |

In some embodiments, * only represents a stereorandom phosphorothioate linkage; *S represents an Sp phosphorothioate linkage; *R represents an Rp phosphorothioate linkage; all non-labeled linkage is a natural phosphate linkage; m preceding a base represents 2'-OMe; eo following a base represents 2'-MOE.

TABLE 2B

| Example Oligonucleotide and Compositions | | SEQ ID NO: |
|---|---|---|
| WV-942 | mU*mC*mA*mA*mG*mG*mA*mA*mG*mA*mU*mG*mG*mC*m A*mU*mU*mU*mC*mU | 261 |
| ONT-395 | mU*SmC*SmA*SmA*SmG*SmG*SmA*SmA*SmG*SmA*SmU*Sm G*SmG*SmC*SmA*SmU*SmU*SmU*SmC*SmU | 262 |
| WV-884 | mU*RmC*RmA*RmA*RmG*RmG*RmA*RmA*RmG*RmA*RmU* RmG*RmG*RmC*RmA*RmU*RmU*RmU*RmC*RmU | 263 |
| WV-885 | mU*SmC*RmA*SmA*RmG*SmG*RmA*SmA*RmG*SmA*RmU*S mG*RmG*SmC*RmA*SmU*RmU*SmU*RmC*SmU | 264 |
| WV-886 | mU*RmC*RmA*RmA*SmG*SmG*SmA*SmA*SmG*SmA*SmU*S mG*SmG*SmC*SmA*SmU*SmU*RmU*RmC*RmU | 265 |
| WV-887 | mU*SmC*SmA*SmA*RmG*RmG*RmA*RmA*RmG*RmA*RmU*R mG*mG*RmC*RmA*RmU*RmU*SmU*SmC*SmU | 266 |
| WV-888 | mU*RmC*RmA*RmA*RmG*RmG*SmA*SmA*RmG*SmA*SmU*R mG*SmG*SmC*RmA*RmU*RmU*RmU*RmC*RmU | 267 |
| WV-889 | mU*SmC*SmA*SmA*SmG*SmG*RmA*RmA*SmG*RmA*RmU*S mG*RmG*RmC*SmA*SmU*SmU*SmU*SmC*SmU | 268 |

TABLE 2B-continued

| Example Oligonucleotide and Compositions | | SEQ ID NO: |
|---|---|---|
| WV-890 | mU*RmC*RmA*RmA*SmG*SmG*RmA*RmA*SmG*RmA*RmU*RmG*SmG*RmC*RmA*SmU*SmU*RmU*RmC*RmU | 269 |
| WV-891 | mU*SmC*SmA*SmA*RmG*RmG*SmA*SmA*RmG*SmA*SmU*SmG*RmG*SmC*SmA*RmU*RmU*SmU*SmC*SmU | 270 |
| WV-892 | mU*SmC*RmA*RmA*RmG*RmG*RmA*RmA*RmG*RmA*RmU*RmG*RmG*RmC*RmA*RmU*RmU*RmU*RmC*SmU | 271 |
| WV-893 | mU*RmC*SmA*SmA*SmG*SmG*SmA*SmA*SmG*SmA*SmU*SmG*SmG*SmC*SmA*SmU*SmU*SmU*SmC*RmU | 272 |
| WV-894 | mU*SmC*RmA*SmA*SmG*RmG*RmA*SmA*SmG*RmA*SmU*SmG*RmG*RmC*RmA*SmU*SmU*SmU*SmC*RmU | 273 |
| WV-895 | mU*RmC*SmA*RmA*RmG*SmG*SmA*RmA*RmG*SmA*RmU*RmG*SmG*SmC*SmA*RmU*RmU*RmU*RmC*SmU | 274 |
| WV-896 | mU*SmC*SmA*RmA*RmG*RmG*RmA*RmA*RmG*RmA*RmU*SmG*RmG*RmC*SmA*RmU*SmU*SmU*SmC*SmU | 275 |
| WV-897 | mU*RmC*RmA*SmA*SmG*SmG*SmA*SmA*SmG*SmA*SmU*RmG*SmG*SmC*RmA*SmU*RmU*RmU*RmC*RmU | 276 |

TABLE 3B

| | Brief Description of Example Oligonucleotides and Compositions. |
|---|---|
| WV-942 | All-2'OMe nucleoside; PS stereochemistry: All stereorandom PS linkages |
| ONT-395 | All-2'OMe nucleoside; PS stereochemistry: All Sp PS linkages |
| WV-884 | All-2'OMe nucleoside; PS stereochemistry: All Rp PS linkages |
| WV-885 | All-2'OMe nucleoside; PS stereochemistry: $(SpRp)_9Sp$ |
| WV-886 | All-2'OMe nucleoside; PS stereochemistry: $Rp_3Sp_{13}Rp_3$ |
| WV-887 | All-2'OMe nucleoside; PS stereochemistry: $Sp_3Rp_{13}Sp_3$ |
| WV-888 | All-2'OMe nucleoside; PS stereochemistry: $Rp_5(SpSpRp)_3Rp_5$ |
| WV-889 | All-2'OMe nucleoside; PS stereochemistry: $Sp_5(RpRpSp)_3Sp_5$ |

TABLE 3B-continued

| | Brief Description of Example Oligonucleotides and Compositions. |
|---|---|
| WV-890 | All-2'OMe nucleoside; PS stereochemistry: $Rp_3Sp_2Rp_2SpRp_3SpRp_2Sp_2Rp_3$ |
| WV-891 | All-2'OMe nucleoside; PS stereochemistry: $Sp_3Rp_2Sp_2RpSp_3RpSp_2Rp_2Sp_3$ |
| WV-892 | All-2'OMe nucleoside; PS stereochemistry: $SpRp_{17}Sp$ |
| WV-893 | All-2'OMe nucleoside; PS stereochemistry: $RpSp_{17}Rp$ |
| WV-894 | All-2'OMe nucleoside; PS stereochemistry: Sp for A and U, Rp for G and C |
| WV-895 | All-2'OMe nucleoside; PS stereochemistry: Sp for G and C, Rp for A and U |
| WV-896 | All-2'OMe nucleoside; PS stereochemistry: Sp for C and U, Rp for A and G |
| WV-897 | All-2'OMe nucleoside; PS stereochemistry: Sp for A and G, Rp for C and U |

TABLE 2C

| Example Oligonucleotide and Compositions | | SEQ ID NO: |
|---|---|---|
| WV-1107 | T*C*A*A*G*G*A*A*G*A*T*G*G*C*A*T*T*T*C*T | 277 |
| WV-1108 | mUmCmAmAmGmGmAmAmGmAmUmGmGmCmAmUmUmUmCmU | 278 |
| WV-1109 | T*RC*RA*RA*RG*RG*RA*RA*RG*RA*RT*RG*RG*RC*RA*RT*RT*RT*RC*RT | 279 |
| WV-1110 | T*SC*SA*SA*SG*SG*SA*SA*SG*SA*ST*SG*SG*SC*SA*ST*ST*ST*SC*ST | 280 |
| WV-1111 | T*SC*SA*SA*SG*SmGmAmAmGmAmUmGmGmCA*ST*ST*ST*SC*ST | 281 |

TABLE 2C-continued

| Example Oligonucleotide and Compositions | | SEQ ID NO: |
|---|---|---|
| WV-1112 | mUmCmAmAG*SG*SA*SmAG*SA*ST*SG*SmGC*SA*ST*SmUm UmCmU | 282 |
| WV-1113 | T*SmCA*SmAG*SmGA*SmAG*SmAT*SmGG*SmCA*SmUT*Sm UC*SmU | 283 |
| WV-1114 | mUC*SmAA*SmGG*SmAA*SmGA*SmUG*SmGC*SmAT*SmUT* SmCmU | 284 |
| WV-1115 | T*SC*SmAmAG*SG*SmAmAG*SA*ST*SmGmGC*SA*SmUmUT* SC*SmU | 285 |
| WV-1116 | T*SC*SA*SmAmGmGA*SA*SmGmAmUG*SG*SmCmAmUT*ST* SC*SmU | 285 |
| WV-1117 | T*SC*SA*SA*SmGmGmAmAG*SA*ST*SmGmGmCmAT*ST*ST* SC*SmU | 287 |
| WV-1118 | T*SC*SA*SmAG*SG*SA*SmAG*SA*ST*SmGG*SC*SA*SmUT*S T*SC*SmU | 288 |
| WV-1119 | mUmCmAmAG*SG*SA*SA*SG*SmAmUmGmGmCA*ST*ST*ST* SC*SmU | 289 |
| WV-1120 | T*SC*SmAmAmGmGmAmAmGmAT*SmGmGC*SmAT*ST*ST*SC *SmU | 290 |
| WV-1131 | T*C*A*A*G*mGmAmAmGmAmUmGmGmCA*T*T*T*C*T | 291 |
| WV-1132 | mUmCmAmAG*G*A*mAG*A*T*G*mGC*A*T*mUmUmCmU | 292 |
| WV-1133 | T*mCA*mAG*mGA*mAG*mAT*mGG*mCA*mUT*mUC*mU | 293 |
| WV-1134 | mUC*mAA*mGG*mAA*mGA*mUG*mGC*mAT*mUT*mCmU | 294 |
| WV-1135 | T*C*mAmAG*G*mAmAG*A*T*mGmGC*A*mUmUT*C*mU | 295 |
| WV-1136 | T*C*A*mAmGmGA*A*mGmAmUG*G*mCmAmUT*T*C*mU | 296 |
| WV-1137 | T*C*A*A*mGmGmAmAG*A*T*mGmGmCmAT*T*T*C*mU | 297 |
| WV-1138 | T*C*A*mAG*G*A*mAG*A*T*mGG*C*A*mUT*T*C*mU | 298 |
| WV-1139 | mUmCmAmAG*G*A*A*G*mAmUmGmGmCA*T*T*T*C*mU | 299 |
| WV-1140 | T*C*mAmAmGmGmAmAmGmAT*mGmGC*mAT*T*T*C*mU | 300 |

TABLE 3C

| | Brief Description of Example Oligonucleotides and Compositions. |
|---|---|
| WV-1107 | All-DNA nucleoside; backbone chemistry: All stereorandom PS linkages |
| WV-1108 | All-2'OMe nucleoside; backbone chemistry: All PO linkages |
| WV-1109 | All-DNA nucleoside; backbone chemistry: All Rp PS linkages |
| WV-1110 | All-DNA nucleoside; backbone chemistry: All Sp PS linkages |
| WV-1111 | Nucleoside chemistry: $(DNA)_5$-$(2'OMe)_9$-$(DNA)_6$; backbone chemistry: PO for 2'OMe, Sp-PS for DNA |
| WV-1112 | Nucleoside chemistry: $(2'OMe)_4$-$(DNA)_3$-(2'OMe)-$(DNA)_4$-(2'OMe)-$(DNA)_3$-$(2'OMe)_4$ nucleoside; backbone chemistry: PO for 2'OMe, Sp-PS for DNA |

TABLE 3C-continued

| | Brief Description of Example Oligonucleotides and Compositions. |
|---|---|
| WV-1113 | Nucleoside chemistry{(DNA)-(2'OMe)}$_{10}$; backbone chemistry: PO for 2'OMe, Sp-PS for DNA |
| WV-1114 | Nucleoside chemistry{(2'OMe)-(DNA)}$_{9}$-(2'OMe)$_{2}$; backbone chemistry: PO for 2'OMe, Sp-PS for DNA |
| WV-1115 | Nucleoside chemistry{(DNA)$_{2}$-(2'OMe)$_{2}$}$_{2}$-(DNA)$_{3}$-{(2'OMe)2-(DNA)$_{2}$}$_{2}$-(2'OMe); backbone chemistry: PO for 2'OMe, Sp-PS for DNA |
| WV-1116 | Nucleoside chemistry: (DNA)$_{3}$-(2'OMe)$_{3}$-(DNA)$_{2}$-(2'OMe)$_{3}$-(DNA)$_{2}$-(2'OMe)$_{3}$-(DNA)$_{3}$-(2'OMe) nucleoside; backbone chemistry: PO for 2'OMe, Sp-PS for DNA |
| WV-1117 | Nucleoside chemistry: (DNA)$_{4}$-(2'OMe)$_{4}$-(DNA)$_{3}$-(2'OMe)$_{4}$-(DNA)$_{4}$-(2'OMe) nucleoside; backbone chemistry: PO for 2'OMe, Sp-PS for DNA |
| WV-1118 | Nucleoside chemistry{(DNA)$_{3}$-(2'OMe)}$_{5}$; backbone chemistry: PO for 2'OMe, Sp-PS for DNA |
| WV-1119 | Nucleoside chemistry: (2'OMe)$_{4}$-(DNA)$_{5}$-(2'OMe)$_{5}$-(DNA)$_{5}$-(2'OMe) nucleoside; backbone chemistry: PO for 2'OMe, Sp-PS for DNA |
| WV-1120 | Nucleoside chemistry: (DNA)$_{2}$-(2'OMe)$_{8}$-(DNA)-(2'OMe)$_{2}$-(DNA)-(2'OMe)-(DNA)$_{4}$-(2'OMe) nucleoside; backbone chemistry: PO for 2'OMe, Sp-PS for DNA |
| WV-1131 | Nucleoside chemistry: (DNA)$_{5}$-(2'OMe)$_{9}$-(DNA)$_{6}$; backbone chemistry: PO for 2'OMe, stereorandom PS for DNA |
| WV-1132 | Nucleoside chemistry: (2'OMe)$_{4}$-(DNA)$_{3}$-(2'OMe)-(DNA)$_{4}$-(2'OMe)-(DNA)$_{3}$-(2'OMe)$_{4}$ nucleoside; backbone chemistry: PO for 2'OMe, stereorandom PS for DNA |
| WV-1133 | Nucleoside chemistry{(DNA)-(2'OMe)}$_{10}$; backbone chemistry: PO for 2'OMe, stereorandom PS for DNA |
| WV-1134 | Nucleoside chemistry{(2'OMe)-(DNA)}$_{9}$-(2'OMe)$_{2}$; backbone chemistry: PO for 2'OMe, stereorandom PS for DNA |
| WV-1135 | Nucleoside chemistry {(DNA)$_{2}$-(2'OMe)$_{2}$}$_{2}$-(DNA)$_{3}$-{(2'OMe)$_{2}$-(DNA)$_{2}$}$_{2}$-(2'OMe); backbone chemistry: PO for 2'OMe, stereorandom PS for DNA |
| WV-1136 | Nucleoside chemistry: (DNA)$_{3}$-(2'OMe)$_{3}$-(DNA)$_{2}$-(2'OMe)$_{3}$-(DNA)$_{2}$-(2'OMe)$_{3}$-(DNA)$_{3}$-(2'OMe) nucleoside; backbone chemistry: PO for 2'OMe, stereorandom PS for DNA |
| WV-1137 | Nucleoside chemistry: (DNA)$_{4}$-(2'OMe)$_{4}$-(DNA)$_{3}$-(2'OMe)$_{4}$-(DNA)$_{4}$-(2'OMe) nucleoside; backbone chemistry: PO for 2'OMe, stereorandom PS for DNA |
| WV-1138 | Nucleoside chemistry{(DNA)$_{3}$-(2'OMe)}$_{5}$; backbone chemistry: PO for 2'OMe, stereorandom PS for DNA |
| WV-1139 | Nucleoside chemistry: (2'OMe)$_{4}$-(DNA)$_{5}$-(2'OMe)$_{5}$-(DNA)$_{5}$-(2'OMe) nucleoside; backbone chemistry: PO for 2'OMe, stereorandom PS for DNA |
| WV-1140 | Nucleoside chemistry: (DNA)$_{2}$-(2'OMe)$_{8}$-(DNA)-(2'OMe)$_{2}$-(DNA)-(2'OMe)-(DNA)$_{4}$-(2'OMe) nucleoside; backbone chemistry: PO for 2'OMe, stereorandom PS for DNA |

TABLE 2D

Example Oligonucleotide and Compositions

| | | SEQ ID NO: |
|---|---|---|
| WV-1709 | fU*fC*fA*fA*fG*fG*fA*fA*fG*fA*fU*fG*fG*fC*fA*fU*fU*fU*fC*fU | 301 |
| WV-1710 | fU*fC*mA*mA*mG*mG*mA*mA*mG*mA*fU*mG*mG*fC*mA*fU*fU*fU*fC*fU | 302 |
| WV-1711 | mU*mC*fA*fA*fG*fG*fA*fA*fG*fA*mU*fG*fG*mC*fA*mU*mU*mU*mC*mU | 303 |
| WV-1712 | mU*fC*mA*fA*mG*fG*mA*fA*mG*fA*mU*fG*mG*fC*mA*fU*mU*fU*mC*fU | 304 |
| WV-1713 | mU*mC*mA*mA*mG*mG*fA*fA*fG*fA*fU*fG*fG*fC*mA*mU*mU*mU*mC*mU | 305 |
| WV-1714 | fU*fC*fA*fA*fG*fG*mA*mA*mG*mA*mU*mG*mG*mC*fA*fU*fU*fU*fC*fU | 306 |
| WV-1715 | mU*fC*mA*mA*fG*fG*mA*mA*fG*mA*mU*fG*fG*fC*mA*mU*mU*mU*fC*mU | 307 |
| WV-1716 | fU*mC*fA*fA*mG*mG*fA*fA*mG*fA*fU*mG*mG*mC*fA*fU*fU*fU*mC*fU | 308 |

TABLE 3D

| | Brief Description of Example Oligonucleotides and Compositions. |
|---|---|
| WV-1709 | All-2'F nucleoside; backbone chemistry: All stereorandom PS linkages |
| WV-1710 | Nucleoside chemistry: 2'F for pyrimidines, 2'OMe for purines; backbone chemistry: All stereorandom PS linkages |
| WV-1711 | Nucleoside chemistry: 2'OMe for pyrimidines, 2'F for purines; backbone chemistry: All stereorandom PS linkages |
| WV-1712 | Nucleoside chemistry: $\{(2'OMe)-(2'F)\}_{10}$; backbone chemistry: All stereorandom PS linkages |
| WV-1713 | Nucleoside chemistry: $(2'OMe)_6-(2'F)_8-(2'OMe)_6$; backbone chemistry: All stereorandom PS linkages |
| WV-1714 | Nucleoside chemistry: $(2'F)_6-(2'OMe)_8-(2'F)_6$; backbone chemistry: All stereorandom PS linkages |
| WV-1715 | Nucleoside chemistry: 2'F for G and C, 2'OMe for A and U; backbone chemistry: All stereorandom PS linkages |
| WV-1716 | Nucleoside chemistry: 2'F for A and U, 2'OMe for G and C; backbone chemistry: All stereorandom PS linkages |

TABLE 2E

Example Oligonucleotide and Compositions

| | | SEQ ID NO: |
|---|---|---|
| WV-XXX1 | mUmCmAmAmGmG*SmA*SmA*RmG*SmA*SmU*RmG*SmG*SmC*RmAmUmUmUmCmU | 309 |
| WV-XXX2 | mUmCmAmAmGmG*RmA*RmA*SmG*RmA*RmU*SmG*RmG*RmC*SmAmUmUmUmCmU | 310 |
| WV-XXX3 | mU*SmCmAmAmGmG*SmA*SmA*RmG*SmA*SmU*RmG*SmG*SmC*RmAmUmUmUmC*SmU | 311 |
| WV-XXX4 | mU*RmCmAmAmGmG*RmA*RmA*SmG*RmA*RmU*SmG*RmG*RmC*SmAmUmUmUmC*RmU | 312 |
| WV-XXX5 | mU*RmCmAmAmGmG*SmA*SmA*RmG*SmA*SmU*RmG*SmG*SmC*RmAmUmUmUmC*RmU | 313 |
| WV-XXX6 | mU*SmCmAmAmGmG*RmA*RmA*SmG*RmA*RmU*SmG*RmG*RmC*SmAmUmUmUmC*SmU | 314 |
| WV-XXX7 | mU*SmC*SmA*SmA*SmG*SmG*SmA*SmA*RmG*SmA*SmU*RmG*SmG*SmC*RmA*SmU*SmU*SmU*SmC*SmU | 315 |
| WV-XXX8 | mU*SmC*RmA*SmA*SmG*RmG*SmA*SmA*RmG*SmA*SmU*RmG*SmG*SmC*RmA*SmU*SmU*RmU*SmC*SmU | 316 |
| WV-XXX9 | mU*RmC*SmA*RmA*RmG*SmG*RmA*RmA*SmG*RmA*RmU*SmG*RmG*RmC*SmA*RmU*RmU*SmU*RmC*RmU | 317 |
| WV-XX10 | mUmCmAmAmGmG*SmA*SmAmG*SmA*SmUmG*SmG*SmCmAmUmUmUmCmU | 318 |
| WV-XX11 | mU*SmCmAmAmGmG*SmA*SmAmG*SmA*SmUmG*SmG*SmCmAmUmUmUmC*SmU | 319 |
| WV-XX12 | mU*SmCmAmAmGmGmAmAmGmAmUmGmGmCmAmUmUmUmC*SmU | 320 |
| WV-XX13 | mU*SmC*SmAmAmGmGmAmAmGmAmU*SmGmGmC*SmAmU*SmU*SmU*SmC*SmU | 321 |
| WV-XX14 | mU*SmC*SmA*SmA*SmG*SmGmAmAmGmAmUmGmGmCmA*SmU*SmU*SmU*SmC*SmU | 322 |
| WV-XX15 | mU*RmC*RmA*RmA*RmG*RmGmAmAmGmAmUmGmGmCmA*RmU*RmU*RmU*RmC*RmU | 323 |
| WV-XX16 | mU*SmC*SmA*SmA*SmG*SmG*RmA*RmA*RmG*RmA*RmU*RmG*RmG*RmC*RA*SmU*SmU*SmU*SmC*SmU | 324 |
| WV-XX17 | mU*RmC*RmA*RmA*RmG*RmG*SmA*SmA*SmG*SmA*SmU*SmG*SmG*SmC*SmA*RmU*RmU*RmU*RmC*RmU | 325 |

TABLE 2E-continued

| Example Oligonucleotide and Compositions | | SEQ ID NO: |
|---|---|---|
| WV-XX18 | mU*SmC*SmA*SmA*SmG*SmG*SmA*SmA*SmG*SmA*SmU*Rm G*RmG*RmC*RA*RmU*RmU*RmU*RmC*RmU | 326 |
| WV-XX19 | mU*RmC*RmA*RmA*RmG*RmG*RmA*RmA*RmG*RmA*RmU* SmG*SmG*SmC*SmA*SmU*SmU*SmU*SmC*SmU | 327 |
| WV-XX20 | mU*RmC*RmA*RmA*RmG*SmG*SmA*RmA*SmG*SmA*RmU*S mG*SmG*RmC*RmA*RmU*RmU*RmU*RmC*RmU | 328 |
| WV-XX21 | mU*RmC*RmA*RmA*RmG*RmG*RmA*SmA*SmG*RmA*SmU*S mG*RmG*SmC*SmA*RmU*RmU*RmU*RmC*RmU | 329 |
| WV-XX22 | fU*SfC*SfA*SfA*SfG*SfG*SfA*SfA*SfG*SfA*SfU*SfG*SfG*SfC* SfA*SfU*SfU*SfU*SfC*SfU | 330 |
| WV-XX23 | fU*RfC*RfA*RfA*RfG*RfG*RfA*RfA*RfG*RfA*RfU*RfG*RfG*R fC*RfA*RfU*RfU*R fU*RfC*RfU | 331 |
| WV-XX24 | fU*RfC*RfA*RfA*RfG*RfG*SfA*SfA*RfG*SfA*SfU*RfG*SfG*Sf C*RfA*RfU*RfU*RfU*RfC*RfU | 332 |
| WV-XX25 | fU*SfC*RfA*RfA*RfG*RfG*RfA*RfA*RfG*RfA*RfU*RfG*RfG*R fC*RfA*RfU*RfU*RfU*RfC*SfU | 333 |
| WV-XX26 | fU*SfC*SfA*RfA*RfG*RfG*RfA*RfA*RfG*RfA*RfU*SfG*RfG*Rf C*SfA*RfU*SfU*SfU*SfC*SfU | 334 |
| WV-XX27 | fU*SfC*SmA*SmA*SmG*SmG*SmA*SmA*SmG*SmA*SfU*SmG* SmG*SfC*SmA*SfU*SfU*SfU*SfC*SfU | 335 |
| WV-XX28 | fU*RfC*RmA*RmA*RmG*RmG*RmA*RmA*RmG*RmA*RfU*Rm G*RmG*RfC*RmA*RfU*RfU*RfU*RfC*RfU | 336 |
| WV-XX29 | fU*RfC*RmA*RmA*RmG*RmG*SmA*SmA*RmG*SmA*SfU*RmG *SmG*SfC*RmA*RfU*RfU*RfU*RfC*RfU | 337 |
| WV-XX30 | fU*SfC*RmA*RmA*RmG*RmG*RmA*RmA*RmG*RmA*RfU*Rm G*RmG*RfC*RmA*RfU*RfU*RfU*RfC*SfU | 338 |
| WV-XX31 | fU*SfC*SmA*RmA*RmG*RmG*RmA*RmA*RmG*RmA*RfU*Sm G*RmG*RfC*SmA*RfU*SfU*SfU*SfC*SfU | 339 |
| WV-XX32 | mU*SmC*SfA*SfA*SfG*SfG*SfA*SfA*SfG*SfA*SmU*SfG*SfG*S mC*SfA*SmU*SmU*SmU*SmC*SmU | 340 |
| WV-XX33 | mU*RmC*RfA*RfA*RfG*RfG*RfA*RfA*RfG*RfA*RmU*RfG*RfG *RmC*RfA*RmU*RmU*R mU*RmC*RmU | 341 |
| WV-XX34 | mU*RmC*RfA*RfA*RfG*RfG*SfA*SfA*RfG*SfA*SmU*RfG*SfG* SmC*RfA*RmU*RmU*RmU*RmC*RmU | 342 |
| WV-XX35 | mU*SmC*RfA*RfA*RfG*RfG*RfA*RfA*RfG*RfA*RmU*RfG*RfG *RmC*RfA*RmU*RmU*RmU*RmC*SmU | 343 |
| WV-XX36 | mU*SmC*SfA*RfA*RfG*RfG*RfA*RfA*RfG*RfA*RmU*SfG*RfG *RmC*SfA*RmU*SmU*SmU*SmC*SmU | 344 |
| WV-XX37 | mU*SfC*SmA*SfA*SmG*SfG*SmA*SfA*SmG*SfA*SmU*SfG*Sm G*SfC*SmA*SfU*SmU*SfU*SmC*SfU | 345 |
| WV-XX38 | mU*RfC*RmA*RfA*RmG*RfG*RmA*RfA*RmG*RfA*RmU*RfG* RmG*RfC*RmA*RfU*RmU*R fU*RmC*RfU | 346 |
| WV-XX39 | mU*RfC*RmA*RfA*RmG*RfG*SmA*SfA*RmG*SfA*SmU*RfG*S mG*SfC*RmA*RfU*RmU*RfU*RmC*RfU | 347 |
| WV-XX40 | mU*SfC*RmA*RfA*RmG*RfG*RmA*RfA*RmG*RfA*RmU*RfG* RmG*RfC*RmA*RfU*RmU*RfU*RmC*SfU | 348 |
| WV-XX41 | mU*SfC*SmA*RfA*RmG*RfG*RmA*RfA*RmG*RfA*RmU*SfG*R mG*RfC*SmA*RfU*SmU*SfU*SmC*SfU | 349 |
| WV-XX42 | mU*SmC*SmA*SmA*SmG*SmG*SfA*SfA*SfG*SfA*SfU*SfG*SfG *SfC*SmA*SmU*SmU*SmU*SmC*SmU | 350 |

TABLE 2E-continued

| Example Oligonucleotide and Compositions | | SEQ ID NO: |
|---|---|---|
| WV-XX43 | mU*RmC*RmA*RmA*RmG*RmG*RfA*RfA*RfG*RfA*RfU*RfG*RfG*RfC*RmA*RmU*RmU*R mU*RmC*RmU | 351 |
| WV-XX44 | mU*RmC*RmA*RmA*RmG*RmG*SfA*SfA*RfG*SfA*SfU*RfG*SfG*SfC*RmA*RmU*RmU*RmU*RmC*RmU | 352 |
| WV-XX45 | mU*SmC*RmA*RmA*RmG*RmG*RfA*RfA*RfG*RfA*RfU*RfG*RfG*RfC*RmA*RmU*RmU*RmU*RmC*SmU | 353 |
| WV-XX46 | mU*SmC*SmA*RmA*RmG*RmG*RfA*RfA*RfG*RfA*RfU*SfG*RfG*RfC*SmA*RmU*SmU*SmU*SmC*SmU | 354 |
| WV-XX47 | fU*SfC*SfA*SfA*SfG*SfG*SmA*SmA*SmG*SmA*SmU*SmG*SmG*SmC*SfA*SfU*SfU*SfU*SfC*SfU | 355 |
| WV-XX48 | fU*RfC*RfA*RfA*RfG*RfG*RmA*RmA*RmG*RmA*RmU*RmG*RmG*RmC*RfA*RfU*RfU*RfU*RfC*RfU | 356 |
| WV-XX49 | fU*RfC*RfA*RfA*RfG*RfG*SmA*SmA*RmG*SmA*SmU*RmG*SmG*SmC*RfA*RfU*RfU*RfU*RfC*RfU | 357 |
| WV-XX50 | fU*SfC*RfA*RfA*RfG*RfG*RmA*RmA*RmG*RmA*RmU*RmG*RmG*RmC*RfA*RfU*RfU*RfU*RfC*SfU | 358 |
| WV-XX51 | fU*SfC*SfA*RfA*RfG*RfG*RmA*RmA*RmG*RmA*RmU*SmG*RmG*RmC*SfA*RfU*SfU*SfU*SfC*SfU | 359 |
| WV-XX52 | mU*SfC*SmA*SmA*SfG*SfG*SmA*SmA*SfG*SmA*SmU*SfG*SfG*SfC*SmA*SmU*SmU*SmU*SfC*SmU | 360 |
| WV-XX53 | mU*RfC*RmA*RmA*RfG*RfG*RmA*RmA*RfG*RmA*RmU*RfG*RfG*RfC*RmA*RmU*RmU*R mU*RfC*RmU | 361 |
| WV-XX54 | mU*RfC*RmA*RmA*RfG*RfG*SmA*SmA*RfG*SmA*SmU*RfG*SfG*SfC*RmA*RmU*RmU*RmU*RfC*RmU | 362 |
| WV-XX55 | mU*SfC*RmA*RmA*RfG*RfG*RmA*RmA*RfG*RmA*RmU*RfG*RfG*RfC*RmA*RmU*RmU*RmU*RfC*SmU | 363 |
| WV-XX56 | mU*SfC*SmA*RmA*RfG*RfG*RmA*RmA*RfG*RmA*RmU*SfG*RfG*RfC*SmA*RmU*SmU*SmU*SfC*SmU | 364 |
| WV-XX57 | fU*SmC*SfA*SfA*SmG*SmG*SfA*SfA*SmG*SfA*SfU*SmG*SmG*SmC*SfA*SfU*SfU*SfU*SmC*SfU | 365 |
| WV-XX58 | fU*RmC*RfA*RfA*RmG*RmG*RfA*RfA*RmG*RfA*RfU*RmG*RmG*RmC*RfA*RfU*RfU*R fU*RmC*RfU | 366 |
| WV-XX59 | fU*RmC*RfA*RfA*RmG*RmG*SfA*SfA*RmG*SfA*SfU*RmG*SmG*SmC*RfA*RfU*RfU*RfU*RmC*RfU | 367 |
| WV-XX60 | fU*SmC*RfA*RfA*RmG*RmG*RfA*RfA*RmG*RfA*RfU*RmG*RmG*RmC*RfA*RfU*RfU*RfU*RmC*SfU | 368 |
| WV-XX61 | fU*SmC*SfA*RfA*RmG*RmG*RfA*RfA*RmG*RfA*RfU*SmG*RmG*RmC*SfA*RfU*SfU*SfU*SmC*SfU | 369 |

TABLE 3E

| | Brief Description of Example Oligonucleotides and Compositions. |
|---|---|
| WV-XXX1 | All-2'OMe nucleoside; backbone chemistry: $(PO)_5(SpSpRp)_3(PO)_5$ |
| WV-XXX2 | All-2'OMe nucleoside; backbone chemistry: $(PO)_5(RpRpSp)_3(PO)_5$ |
| WV-XXX3 | All-2'OMe nucleoside; backbone chemistry: $Sp(PO)_4(SpSpRp)_3(PO)_4Sp$ |
| WV-XXX4 | All-2'OMe nucleoside; backbone chemistry: $Rp(PO)_4(RpRpSp)_3(PO)_4Rp$ |

TABLE 3E-continued

| | Brief Description of Example Oligonucleotides and Compositions. |
|---|---|
| WV-XXX5 | All-2'OMe nucleoside; backbone chemistry: $Rp(PO)_4(SpSpRp)_3(PO)_4Rp$ |
| WV-XXX6 | All-2'OMe nucleoside; backbone chemistry: $Sp(PO)_4(RpRpSp)_3(PO)_4$ Sp |
| WV-XXX7 | All-2'OMe nucleoside; backbone chemistry: $Sp_5(SpSpRp)_3Sp_5$ |
| WV-XXX8 | All-2'OMe nucleoside; backbone chemistry: $SpRp(SpSpRp)_5SP_2$ |
| WV-XXX9 | All-2'OMe nucleoside; backbone chemistry: $RpSp(RpRpSp)_5Rp_2$ |
| WV-XX10 | All-2'OMe nucleoside; backbone chemistry: $(PO)_5(SpSpPO)_3(PO)_5$ |
| WV-XX11 | All-2'OMe nucleoside; backbone chemistry: $Sp(PO)_4(SpSpPO)_3(PO)_4Sp$ |
| WV-XX12 | All-2'OMe nucleoside; backbone chemistry: $Sp(PO)_{17}Sp$ |
| WV-XX13 | All-2'OMe nucleoside; backbone chemistry: Sp for C and U, PO for A and G |
| WV-XX14 | All-2'OMe nucleoside; backbone chemistry: $Sp_5(PO)_9Sp_5$ |
| WV-XX15 | All-2'OMe nucleoside; backbone chemistry: $Rp_5(PO)_9Rp_5$ |
| WV-XX16 | All-2'OMe nucleoside; backbone chemistry: $Sp_5Rp_9Sp_5$ |
| WV-XX17 | All-2'OMe nucleoside; backbone chemistry: $Rp_5Sp_9Rp_5$ |
| WV-XX18 | All-2'OMe nucleoside; backbone chemistry: $Sp_{10}Rp_9$ |
| WV-XX19 | All-2'OMe nucleoside; backbone chemistry: $Rp_{10}Sp_9$ |
| WV-XX20 | All-2'OMe nucleoside; backbone chemistry: $Rp_4(SpSpRp)_3Rp_6$ |
| WV-XX21 | All-2'OMe nucleoside; backbone chemistry: $Rp_6(SpSpRp)_3Rp_4$ |
| WV-XX22 | All-2'F nucleoside; backbone chemistry: All Sp PS linkages |
| WV-XX23 | All-2'F nucleoside; backbone chemistry: All Rp PS linkages |
| WV-XX24 | All-2'F nucleoside; backbone chemistry: $Rp_5(SpSpRp)_3Rp_5$ |
| WV-XX25 | All-2'F nucleoside; backbone chemistry: $SpRp_{17}Sp$ |
| WV-XX26 | All-2'F nucleoside; backbone chemistry: Sp for C and U, Rp for A and G |
| WV-XX27 | Nucleoside chemistry: 2'F for pyrimidines, 2'OMe for purines; backbone chemistry: All Sp PS linkages |
| WV-XX28 | Nucleoside chemistry: 2'F for pyrimidines, 2'OMe for purines; backbone chemistry: All Rp PS linkages |
| WV-XX29 | Nucleoside chemistry: 2'F for pyrimidines, 2'OMe for purines; backbone chemistry: $Rp_5(SpSpRp)_3Rp_5$ |
| WV-XX30 | Nucleoside chemistry: 2'F for pyrimidines, 2'OMe for purines; backbone chemistry: $SpRp_{17}Sp$ |
| WV-XX31 | Nucleoside chemistry: 2'F for pyrimidines, 2'OMe for purines; backbone chemistry: Sp for C and U, Rp for A and G |
| WV-XX32 | Nucleoside chemistry: 2'OMe for pyrimidines, 2'F for purines; backbone chemistry: All Sp PS linkages |
| WV-XX33 | Nucleoside chemistry: 2'OMe for pyrimidines, 2'F for purines; backbone chemistry: All Rp PS linkages |
| WV-XX34 | Nucleoside chemistry: 2'OMe for pyrimidines, 2'F for purines; backbone chemistry: $Rp_5(SpSpRp)_3Rp_5$ |
| WV-XX35 | Nucleoside chemistry: 2'OMe for pyrimidines, 2'F for purines; backbone chemistry: $SpRp_{17}Sp$ |
| WV-XX36 | Nucleoside chemistry: 2'OMe for pyrimidines, 2'F for purines; backbone chemistry: Sp for C and U, Rp for A and G |
| WV-XX37 | Nucleoside chemistry: $\{(2'OMe)\text{-}(2'F)\}_{10}$; backbone chemistry: All Sp PS linkages |
| WV-XX38 | Nucleoside chemistry: $\{(2'OMe)\text{-}(2'F)\}_{10}$; backbone chemistry: All Rp PS linkages |
| WV-XX39 | Nucleoside chemistry: $\{(2'OMe)\text{-}(2'F)\}_{10}$; backbone chemistry: $Rp_5(SpSpRp)_3Rp_5$ |
| WV-XX40 | Nucleoside chemistry: $\{(2'OMe)\text{-}(2'F)\}_{10}$; backbone chemistry: $SpRp_{17}Sp$ |
| WV-XX41 | Nucleoside chemistry: $\{(2'OMe)\text{-}(2'F)\}_{10}$; backbone chemistry: Sp for C and U, Rp for A and G |
| WV-XX42 | Nucleoside chemistry: $(2'OMe)_6\text{-}(2'F)_8\text{-}(2'OMe)_6$; backbone chemistry: All Sp PS linkages |
| WV-XX43 | Nucleoside chemistry: $(2'OMe)_6\text{-}(2'F)_8\text{-}(2'OMe)_6$; backbone chemistry: All Rp PS linkages |
| WV-XX44 | Nucleoside chemistry: $(2'OMe)_6\text{-}(2'F)_8\text{-}(2'OMe)_6$; backbone chemistry: $Rp_5(SpSpRp)_3Rp_5$ |
| WV-XX45 | Nucleoside chemistry: $(2'OMe)_6\text{-}(2'F)_8\text{-}(2'OMe)_6$; backbone chemistry: $SpRp_{17}Sp$ |
| WV-XX46 | Nucleoside chemistry: $(2'OMe)_6\text{-}(2'F)_8\text{-}(2'OMe)_6$; backbone chemistry: Sp for C and U, Rp for A and G |
| WV-XX47 | Nucleoside chemistry: $(2'F)_6\text{-}(2'OMe)_8\text{-}(2'F)_6$; backbone chemistry: All Sp PS linkages |
| WV-XX48 | Nucleoside chemistry: $(2'F)_6\text{-}(2'OMe)_8\text{-}(2'F)_6$; backbone chemistry: All Rp PS linkages |

TABLE 3E-continued

| | Brief Description of Example Oligonucleotides and Compositions. |
|---|---|
| WV-XX49 | Nucleoside chemistry: $(2'F)_6$-$(2'OMe)_8$-$(2'F)_6$; backbone chemistry: $Rp_5(SpSpRp)_3Rp_5$ |
| WV-XX50 | Nucleoside chemistry: (2'F)6-$(2'OMe)_8$-$(2'F)_6$; backbone chemistry: $SpRp_{17}Sp$ |
| WV-XX51 | Nucleoside chemistry: $(2'F)_6$-$(2'OMe)_8$-$(2'F)_6$; backbone chemistry: : Sp for C and U, Rp for A and G |
| WV-XX52 | Nucleoside chemistry: 2'F for G and C, 2'OMe for A and U; backbone chemistry: All Sp PS linkages |
| WV-XX53 | Nucleoside chemistry: 2'F for G and C, 2'OMe for A and U; backbone chemistry: All Rp PS linkages |
| WV-XX54 | Nucleoside chemistry: 2'F for G and C, 2'OMe for A and U; backbone chemistry: $Rp_5(SpSpRp)_3Rp_5$ |
| WV-XX55 | Nucleoside chemistry: 2'F for G and C, 2'OMe for A and U; backbone chemistry: $SpRp_{17}Sp$ |
| WV-XX56 | Nucleoside chemistry: 2'F for G and C, 2'OMe for A and U; backbone chemistry: Sp for C and U, Rp for A and G |
| WV-XX57 | Nucleoside chemistry: 2'F for A and U, 2'OMe for G and C; backbone chemistry: All Sp PS linkages |
| WV-XX58 | Nucleoside chemistry: 2'F for A and U, 2'OMe for G and C; backbone chemistry: All Rp PS linkages |
| WV-XX59 | Nucleoside chemistry: 2'F for A and U, 2'OMe for G and C; backbone chemistry: $Rp_5(SpSpRp)_3Rp_5$ |
| WV-XX60 | Nucleoside chemistry: 2'F for A and U, 2'OMe for G and C; backbone chemistry: $SpRp_{17}Sp$ |
| WV-XX61 | Nucleoside chemistry: 2'F for A and U, 2'OMe for G and C; backbone chemistry: Sp for C and U, Rp for A and G |

TABLE 4

Example Oligonucleotides

| WAVE ID | Base Sequence | SEQ ID NO: | Description | SEQ ID NO: | Stereochemistry[1] | Notes | Target/Program |
|---|---|---|---|---|---|---|---|
| ONT-395 | UCAAGGAAGAUGGCAUUUCU | 54 | mU*SmC*SmA*SmA*SmG*SmG*SmA*SmA*SmG*SmA*SmU*SmG*SmG*SmC*SmA*SmU*SmU*SmU*SmC*SmU | 262 | SSSSSSSSSSSSSSSSSSS | Chiral version of PRO051 (Drisapersen) | DMD |
| WV-942 | UCAAGGAAGAUGGCAUUUCU | 54 | mU*mC*mA*mA*mG*mG*mA*mA*mG*mA*mU*mG*mG*mC*mA*mU*mU*mU*mC*mU | 261 | XXXXXXXXXXXXXXXXXXX | PRO051 (Drisapersen) | DMD |
| WV-943 | GGCCAAACCUCGGCUUACCU | 66 | mG*mG*mC*mC*mA*mA*mA*mC*mC*mU*mC*mG*mG*mC*mU*mU*mA*mC*mC*mU | 710 | XXXXXXXXXXXXXXXXXXX | Exon 23 control | DMD |
| WV-2165 | CUCCAACAUCAAGGAAGAUGGCAUUUCUAG | 75 | mC*mU*mC*mC*mA*mA*mC*mA*mU*mC*mA*mA*mG*mG*mA*mA*mG*mA*mU*mG*mG*mC*mA*mU*mU*mU*mC*mU*mA*mG | 438 | XXXXXXXXXXXXXXXXXXXXXXXXXXXXX | eteplirsen-all-2'Ome 30mer | DMD |
| WV-2179 | ACCAGAGUAACAGUCUGAGUAGGAG | 76 | mA*mC*mC*mA*mG*mA*mG*mU*mA*mA*mC*mA*mG*mU*mC*mU*mG*mA*mG*mU*mA*mG*mG*mA*mG | 439 | XXXXXXXXXXXXXXXXXXXXXXXX | 25-mer 2'-OMethyl | DMD |
| WV-2180 | CACCAGAGUAACAGUCUGAGUAGGA | 77 | mC*mA*mC*mC*mA*mG*mA*mG*mU*mA*mA*mC*mA*mG*mU*mC*mU*mG*mA*mG*mU*mA*mG*mG*mA | 440 | XXXXXXXXXXXXXXXXXXXXXXXX | 25-mer 2'-OMethyl | DMD |
| WV-2181 | UCACCAGAGUAACAGUCUGAGUAGG | 78 | mU*mC*mA*mC*mC*mA*mG*mA*mG*mU*mA*mA*mC*mA*mG*mU*mC*mU*mG*mA*mG*mU*mA*mG*mG | 441 | XXXXXXXXXXXXXXXXXXXXXXXX | 25-mer 2'-OMethyl | DMD |
| WV-2182 | GUCACCAGAGUAACAGUCUGAGUAG | 79 | mG*mU*mC*mA*mC*mC*mA*mG*mA*mG*mU*mA*mA*mC*mA*mG*mU*mC*mU*mG*mA*mG*mU*mA*mG | 442 | XXXXXXXXXXXXXXXXXXXXXXXX | 25-mer 2'-OMethyl | DMD |
| WV-2183 | GUUGUGUCACCAGAGUAACAGUCUG | 80 | mG*mU*mU*mG*mU*mG*mU*mC*mA*mC*mC*mA*mG*mA*mG*mU*mA*mA*mC*mA*mG*mU*mC*mU*mG | 443 | XXXXXXXXXXXXXXXXXXXXXXXX | 25-mer 2'-OMethyl | DMD |
| WV-2184 | GGUUGUGUCACCAGAGUAACAGUCU | 81 | mG*mG*mU*mU*mG*mU*mG*mU*mC*mA*mC*mC*mA*mG*mA*mG*mU*mA*mA*mC*mA*mG*mU*mC*mU | 444 | XXXXXXXXXXXXXXXXXXXXXXXX | 25-mer 2'-OMethyl | DMD |

TABLE 4-continued

| Example Oligonucleotides | | | | | | | |
|---|---|---|---|---|---|---|---|
| WAVE ID | Base Sequence | SEQ ID NO: | Description | SEQ ID NO: | Stereochemistry[1] | Notes | Target/Program |
| WV-2185 | AGGUUGUGUCACCAGAGUAACAGUC | 82 | mA*mG*mG*mU*mU*mG*mU*mG*mU*mC*mA*mC*mC*mA*mG*mA*mG*mU*mA*mA*mC*mA*mG*mU*mC | 445 | XXXXXXXXXXXXXXXXXXXXXXXX | 25-mer 2'-OMethyl | DMD |
| WV-2186 | CAGGUUGUGUCACCAGAGUAACAGU | 83 | mC*mA*mG*mG*mU*mU*mG*mU*mG*mU*mC*mA*mC*mC*mA*mG*mA*mG*mU*mA*mA*mC*mA*mG*mU | 446 | XXXXXXXXXXXXXXXXXXXXXXXX | 25-mer 2'-OMethyl | DMD |
| WV-2187 | ACAGGUUGUGUCACCAGAGUAACAG | 84 | mA*mC*mA*mG*mG*mU*mU*mG*mU*mG*mU*mC*mA*mC*mC*mA*mG*mA*mG*mU*mA*mA*mC*mA*mG | 447 | XXXXXXXXXXXXXXXXXXXXXXXX | 25-mer 2'-OMethyl | DMD |
| WV-2188 | CCACAGGUUGUGUCACCAGAGUAAC | 85 | mC*mC*mA*mC*mA*mG*mG*mU*mU*mG*mU*mG*mU*mC*mA*mC*mC*mA*mG*mA*mG*mU*mA*mA*mC | 448 | XXXXXXXXXXXXXXXXXXXXXXXX | 25-mer 2'-OMethyl | DMD |
| WV-2189 | ACCACAGGUUGUGUCACCAGAGUAA | 86 | mA*mC*mC*mA*mC*mA*mG*mG*mU*mU*mG*mU*mG*mU*mC*mA*mC*mC*mA*mG*mA*mG*mU*mA*mA | 449 | XXXXXXXXXXXXXXXXXXXXXXXX | 25-mer 2'-OMethyl | DMD |
| WV-2190 | AACCACAGGUUGUGUCACCAGAGUA | 87 | mA*mA*mC*mC*mA*mC*mA*mG*mG*mU*mU*mG*mU*mG*mU*mC*mA*mC*mC*mA*mG*mA*mG*mU*mA | 450 | XXXXXXXXXXXXXXXXXXXXXXXX | 25-mer 2'-OMethyl | DMD |
| WV-2191 | UAACCACAGGUUGUGUCACCAGAGU | 88 | mU*mA*mA*mC*mC*mA*mC*mA*mG*mG*mU*mU*mG*mU*mG*mU*mC*mA*mC*mC*mA*mG*mA*mG*mU | 451 | XXXXXXXXXXXXXXXXXXXXXXXX | 25-mer 2'-OMethyl | DMD |
| WV-2192 | GUAACCACAGGUUGUGUCACCAGAG | 89 | mG*mU*mA*mA*mC*mC*mA*mC*mA*mG*mG*mU*mU*mG*mU*mG*mU*mC*mA*mC*mC*mA*mG*mA*mG | 452 | XXXXXXXXXXXXXXXXXXXXXXXX | 25-mer 2'-OMethyl | DMD |
| WV-2193 | AGUAACCACAGGUUGUGUCACCAGA | 90 | mA*mG*mU*mA*mA*mC*mC*mA*mC*mA*mG*mG*mU*mU*mG*mU*mG*mU*mC*mA*mC*mC*mA*mG*mA | 453 | XXXXXXXXXXXXXXXXXXXXXXXX | 25-mer 2'-OMethyl | DMD |

TABLE 4-continued

Example Oligonucleotides

| WAVE ID | Base Sequence | SEQ ID NO: | Description | SEQ ID NO: | Stereochemistry[1] | Notes | Target/Program |
|---|---|---|---|---|---|---|---|
| WV-2194 | UAGUAACCACAGGUUGUGUCACCAG | 91 | mU*mA*mG*mU*mA*mA*mC*mC*mA*mC*mA*mG*mG*mU*mU*mG*mU*mG*mU*mC*mA*mC*mC*mA*mG | 454 | XXXXXXXXXXXXXXXXXXXXXXXX | 25-mer 2'-OMethyl | DMD |
| WV-2195 | UUAGUAACCACAGGUUGUGUCACCA | 92 | mU*mU*mA*mG*mU*mA*mA*mC*mC*mA*mC*mA*mG*mG*mU*mU*mG*mU*mG*mU*mC*mA*mC*mC*mA | 455 | XXXXXXXXXXXXXXXXXXXXXXXX | 25-mer 2'-OMethyl | DMD |
| WV-2196 | CUUAGUAACCACAGGUUGUGUCACC | 93 | mC*mU*mU*mA*mG*mU*mA*mA*mC*mC*mA*mC*mA*mG*mG*mU*mU*mG*mU*mG*mU*mC*mA*mC*mC | 456 | XXXXXXXXXXXXXXXXXXXXXXXX | 25-mer 2'-OMethyl | DMD |
| WV-2197 | CCUUAGUAACCACAGGUUGUGUCAC | 94 | mC*mC*mU*mU*mA*mG*mU*mA*mA*mC*mC*mA*mC*mA*mG*mG*mU*mU*mG*mU*mG*mU*mC*mA*mC | 457 | XXXXXXXXXXXXXXXXXXXXXXXX | 25-mer 2'-OMethyl | DMD |
| WV-2198 | UCCUUAGUAACCACAGGUUGUGUCA | 95 | mU*mC*mC*mU*mU*mA*mG*mU*mA*mA*mC*mC*mA*mC*mA*mG*mG*mU*mU*mG*mU*mG*mU*mC*mA | 458 | XXXXXXXXXXXXXXXXXXXXXXXX | 25-mer 2'-OMethyl | DMD |
| WV-2199 | GUUUCCUUAGUAACCACAGGUUGUG | 96 | mG*mU*mU*mU*mC*mC*mU*mU*mA*mG*mU*mA*mA*mC*mC*mA*mC*mA*mG*mG*mU*mU*mG*mU*mG | 459 | XXXXXXXXXXXXXXXXXXXXXXXX | 25-mer 2'-OMethyl | DMD |
| WV-2200 | AGUUUCCUUAGUAACCACAGGUUGU | 97 | mA*mG*mU*mU*mU*mC*mC*mU*mU*mA*mG*mU*mA*mA*mC*mC*mA*mC*mA*mG*mG*mU*mU*mG*mU | 460 | XXXXXXXXXXXXXXXXXXXXXXXX | 25-mer 2'-OMethyl | DMD |
| WV-2201 | CAGUUUCCUUAGUAACCACAGGUUG | 98 | mC*mA*mG*mU*mU*mU*mC*mC*mU*mU*mA*mG*mU*mA*mA*mC*mC*mA*mC*mA*mG*mG*mU*mU*mG | 461 | XXXXXXXXXXXXXXXXXXXXXXXX | 25-mer 2'-OMethyl | DMD |
| WV-2202 | GCAGUUUCCUUAGUAACCACAGGUU | 99 | mG*mC*mA*mG*mU*mU*mU*mC*mC*mU*mU*mA*mG*mU*mA*mA*mC*mC*mA*mC*mA*mG*mG*mU*mU | 462 | XXXXXXXXXXXXXXXXXXXXXXXX | 25-mer 2'-OMethyl | DMD |

TABLE 4-continued

Example Oligonucleotides

| WAVE ID | Base Sequence | SEQ ID NO: | Description | SEQ ID NO: | Stereochemistry[1] | Notes | Target/Program |
|---|---|---|---|---|---|---|---|
| WV-2203 | GGCAGUUUCCUUAGUAACCACAGGU | 100 | mG*mG*mC*mA*mG*mU*mU*mU*mC*mC*mU*mU*mA*mG*mU*mA*mA*mC*mC*mA*mC*mA*mG*mG*mU | 463 | XXXXXXXXXXXXXXXXXXXXXXXX | 25-mer 2'-OMethyl | DMD |
| WV-2204 | UGGCAGUUUCCUUAGUAACCACAGG | 101 | mU*mG*mG*mC*mA*mG*mU*mU*mU*mC*mC*mU*mU*mA*mG*mU*mA*mA*mC*mC*mA*mC*mA*mG*mG | 464 | XXXXXXXXXXXXXXXXXXXXXXXX | 25-mer 2'-OMethyl | DMD |
| WV-2205 | AUGGCAGUUUCCUUAGUAACCACAG | 102 | mA*mU*mG*mG*mC*mA*mG*mU*mU*mU*mC*mC*mU*mU*mA*mG*mU*mA*mA*mC*mC*mA*mC*mA*mG | 465 | XXXXXXXXXXXXXXXXXXXXXXXX | 25-mer 2'-OMethyl | DMD |
| WV-2206 | AGAUGGCAGUUUCCUUAGUAACCAC | 103 | mA*mG*mA*mU*mG*mG*mC*mA*mG*mU*mU*mU*mC*mC*mU*mU*mA*mG*mU*mA*mA*mC*mC*mA*mC | 466 | XXXXXXXXXXXXXXXXXXXXXXXX | 25-mer 2'-OMethyl | DMD |
| WV-2207 | GAGAUGGCAGUUUCCUUAGUAACCA | 104 | mG*mA*mG*mA*mU*mG*mG*mC*mA*mG*mU*mU*mU*mC*mC*mU*mU*mA*mG*mU*mA*mA*mC*mC*mA | 467 | XXXXXXXXXXXXXXXXXXXXXXXX | 25-mer 2'-OMethyl | DMD |
| WV-2208 | GGAGAUGGCAGUUUCCUUAGUAACC | 105 | mG*mG*mA*mG*mA*mU*mG*mG*mC*mA*mG*mU*mU*mU*mC*mC*mU*mU*mA*mG*mU*mA*mA*mC*mC | 468 | XXXXXXXXXXXXXXXXXXXXXXXX | 25-mer 2'-OMethyl | DMD |
| WV-2209 | UGGAGAUGGCAGUUUCCUUAGUAAC | 106 | mU*mG*mG*mA*mG*mA*mU*mG*mG*mC*mA*mG*mU*mU*mU*mC*mC*mU*mU*mA*mG*mU*mA*mA*mC | 469 | XXXXXXXXXXXXXXXXXXXXXXXX | 25-mer 2'-OMethyl | DMD |
| WV-2210 | UUGGAGAUGGCAGUUUCCUUAGUAA | 107 | mU*mU*mG*mG*mA*mG*mA*mU*mG*mG*mC*mA*mG*mU*mU*mU*mC*mC*mU*mU*mA*mG*mU*mA*mA | 470 | XXXXXXXXXXXXXXXXXXXXXXXX | 25-mer 2'-OMethyl | DMD |
| WV-2211 | UUUGGAGAUGGCAGUUUCCUUAGUA | 108 | mU*mU*mU*mG*mG*mA*mG*mA*mU*mG*mG*mC*mA*mG*mU*mU*mU*mC*mC*mU*mU*mA*mG*mU*mA | 471 | XXXXXXXXXXXXXXXXXXXXXXXX | 25-mer 2'-OMethyl | DMD |

TABLE 4-continued

| Example Oligonucleotides | | | | | | | |
|---|---|---|---|---|---|---|---|
| WAVE ID | Base Sequence | SEQ ID NO: | Description | SEQ ID NO: | Stereochemistry[1] | Notes | Target/Program |
| WV-2212 | AGUUUGGAGAUGGCAGUUUCCUUAG | 109 | mA*mG*mU*mU*mU*mG*mG*mA*mG*mA*mU*mG*mG*mC*mA*mG*mU*mU*mU*mC*mC*mU*mU*mA*mG | 472 | XXXXXXXXXXXXXXXXXXXXXXXX | 25-mer 2'-OMethyl | DMD |
| WV-2213 | UAGUUUGGAGAUGGCAGUUUCCUUA | 110 | mU*mA*mG*mU*mU*mU*mG*mG*mA*mG*mA*mU*mG*mG*mC*mA*mG*mU*mU*mU*mC*mC*mU*mU*mA | 473 | XXXXXXXXXXXXXXXXXXXXXXXX | 25-mer 2'-OMethyl | DMD |
| WV-2214 | CUAGUUUGGAGAUGGCAGUUUCCUU | 111 | mC*mU*mA*mG*mU*mU*mU*mG*mG*mA*mG*mA*mU*mG*mG*mC*mA*mG*mU*mU*mU*mC*mC*mU*mU | 474 | XXXXXXXXXXXXXXXXXXXXXXXX | 25-mer 2'-OMethyl | DMD |
| WV-2215 | UCUAGUUUGGAGAUGGCAGUUUCCU | 112 | mU*mC*mU*mA*mG*mU*mU*mU*mG*mG*mA*mG*mA*mU*mG*mG*mC*mA*mG*mU*mU*mU*mC*mC*mU | 475 | XXXXXXXXXXXXXXXXXXXXXXXX | 25-mer 2'-OMethyl | DMD |
| WV-2216 | UUCUAGUUUGGAGAUGGCAGUUUCC | 113 | mU*mU*mC*mU*mA*mG*mU*mU*mU*mG*mG*mA*mG*mA*mU*mG*mG*mC*mA*mG*mU*mU*mU*mC*mC | 476 | XXXXXXXXXXXXXXXXXXXXXXXX | 25-mer 2'-OMethyl | DMD |
| WV-2217 | CAUUUCUAGUUUGGAGAUGGCAGUU | 114 | mC*mA*mU*mU*mU*mC*mU*mA*mG*mU*mU*mU*mG*mG*mA*mG*mA*mU*mG*mG*mC*mA*mG*mU*mU | 477 | XXXXXXXXXXXXXXXXXXXXXXXX | 25-mer 2'-OMethyl | DMD |
| WV-2218 | GCAUUUCUAGUUUGGAGAUGGCAGU | 115 | mG*mC*mA*mU*mU*mU*mC*mU*mA*mG*mU*mU*mU*mG*mG*mA*mG*mA*mU*mG*mG*mC*mA*mG*mU | 478 | XXXXXXXXXXXXXXXXXXXXXXXX | 25-mer 2'-OMethyl | DMD |
| WV-2219 | AUGGCAUUUCUAGUUUGGAGAUGGC | 116 | mA*mU*mG*mG*mC*mA*mU*mU*mU*mC*mU*mA*mG*mU*mU*mU*mG*mG*mA*mG*mA*mU*mG*mG*mC | 479 | XXXXXXXXXXXXXXXXXXXXXXXX | 25-mer 2'-OMethyl | DMD |
| WV-2220 | GAAGAUGGCAUUUCUAGUUUGGAGA | 117 | mG*mA*mA*mG*mA*mU*mG*mG*mC*mA*mU*mU*mU*mC*mU*mA*mG*mU*mU*mU*mG*mG*mA*mG*mA | 480 | XXXXXXXXXXXXXXXXXXXXXXXX | 25-mer 2'-OMethyl | DMD |

TABLE 4-continued

Example Oligonucleotides

| WAVE ID | Base Sequence | SEQ ID NO: | Description | SEQ ID NO: | Stereochemistry[1] | Notes | Target/Program |
|---|---|---|---|---|---|---|---|
| WV-2221 | AGGAAGAUGGCAUUUCUAGUUUGGA | 118 | mA*mG*mG*mA*mA*mG*mA*mU*mG*mG*mC*mA*mU*mU*mU*mC*mU*mA*mG*mU*mU*mU*mG*mG*mA | 481 | XXXXXXXXXXXXXXXXXXXXXXXX | 25-mer 2'-OMethyl | DMD |
| WV-2222 | AAGGAAGAUGGCAUUUCUAGUUUGG | 119 | mA*mA*mG*mG*mA*mA*mG*mA*mU*mG*mG*mC*mA*mU*mU*mU*mC*mU*mA*mG*mU*mU*mU*mG*mG | 482 | XXXXXXXXXXXXXXXXXXXXXXXX | 25-mer 2'-OMethyl | DMD |
| WV-2223 | CAAGGAAGAUGGCAUUUCUAGUUUG | 120 | mC*mA*mA*mG*mG*mA*mA*mG*mA*mU*mG*mG*mC*mA*mU*mU*mU*mC*mU*mA*mG*mU*mU*mU*mG | 483 | XXXXXXXXXXXXXXXXXXXXXXXX | 25-mer 2'-OMethyl | DMD |
| WV-2224 | CAUCAAGGAAGAUGGCAUUUCUAGU | 121 | mC*mA*mU*mC*mA*mA*mG*mG*mA*mA*mG*mA*mU*mG*mG*mC*mA*mU*mU*mU*mC*mU*mA*mG*mU | 484 | XXXXXXXXXXXXXXXXXXXXXXXX | 25-mer 2'-OMethyl | DMD |
| WV-2225 | ACAUCAAGGAAGAUGGCAUUUCUAG | 122 | mA*mC*mA*mU*mC*mA*mA*mG*mG*mA*mA*mG*mA*mU*mG*mG*mC*mA*mU*mU*mU*mC*mU*mA*mG | 485 | XXXXXXXXXXXXXXXXXXXXXXXX | 25-mer 2'-OMethyl | DMD |
| WV-2226 | AACAUCAAGGAAGAUGGCAUUUCUA | 123 | mA*mA*mC*mA*mU*mC*mA*mA*mG*mG*mA*mA*mG*mA*mU*mG*mG*mC*mA*mU*mU*mU*mC*mU*mA | 486 | XXXXXXXXXXXXXXXXXXXXXXXX | 25-mer 2'-OMethyl | DMD |
| WV-2227 | CAACAUCAAGGAAGAUGGCAUUUCU | 124 | mC*mA*mA*mC*mA*mU*mC*mA*mA*mG*mG*mA*mA*mG*mA*mU*mG*mG*mC*mA*mU*mU*mU*mC*mU | 487 | XXXXXXXXXXXXXXXXXXXXXXXX | 25-mer 2'-OMethyl | DMD |
| WV-2228 | CUCCAACAUCAAGGAAGAUGGCAUU | 125 | mC*mU*mC*mC*mA*mA*mC*mA*mU*mC*mA*mA*mG*mG*mA*mA*mG*mA*mU*mG*mG*mC*mA*mU*mU | 488 | XXXXXXXXXXXXXXXXXXXXXXXX | 25-mer 2'-OMethyl | DMD |
| WV-2229 | ACCUCCAACAUCAAGGAAGAUGGCA | 126 | mA*mC*mC*mU*mC*mC*mA*mA*mC*mA*mU*mC*mA*mA*mG*mG*mA*mA*mG*mA*mU*mG*mG*mC*mA | 489 | XXXXXXXXXXXXXXXXXXXXXXXX | 25-mer 2'-OMethyl | DMD |

TABLE 4-continued

| Example Oligonucleotides | | | | | | | |
|---|---|---|---|---|---|---|---|
| WAVE ID | Base Sequence | SEQ ID NO: | Description | SEQ ID NO: | Stereochemistry[1] | Notes | Target/Program |
| WV-2230 | GUACCUCCAACAUCAAGGAAGAUGG | 127 | mG*mU*mA*mC*mC*mU*mC*mC*mA*mA*mC*mA*mU*mC*mA*mA*mG*mG*mA*mA*mG*mA*mU*mG*mG | 490 | XXXXXXXXXXXXXXXXXXXXXXXX | 25-mer 2'-OMethyl | DMD |
| WV-2231 | AGGUACCUCCAACAUCAAGGAAGAU | 128 | mA*mG*mG*mU*mA*mC*mC*mU*mC*mC*mA*mA*mC*mA*mU*mC*mA*mA*mG*mG*mA*mA*mG*mA*mU | 491 | XXXXXXXXXXXXXXXXXXXXXXXX | 25-mer 2'-OMethyl | DMD |
| WV-2232 | AGAGCAGGUACCUCCAACAUCAAGG | 129 | mA*mG*mA*mG*mC*mA*mG*mG*mU*mA*mC*mC*mU*mC*mC*mA*mA*mC*mA*mU*mC*mA*mA*mG*mG | 492 | XXXXXXXXXXXXXXXXXXXXXXXX | 25-mer 2'-OMethyl | DMD |
| WV-2233 | CAGAGCAGGUACCUCCAACAUCAAG | 130 | mC*mA*mG*mA*mG*mC*mA*mG*mG*mU*mA*mC*mC*mU*mC*mC*mA*mA*mC*mA*mU*mC*mA*mA*mG | 493 | XXXXXXXXXXXXXXXXXXXXXXXX | 25-mer 2'-OMethyl | DMD |
| WV-2234 | CUGCCAGAGCAGGUACCUCCAACAU | 131 | mC*mU*mG*mC*mC*mA*mG*mA*mG*mC*mA*mG*mG*mU*mA*mC*mC*mU*mC*mC*mA*mA*mC*mA*mU | 494 | XXXXXXXXXXXXXXXXXXXXXXXX | 25-mer 2'-OMethyl | DMD |
| WV-2235 | UCUGCCAGAGCAGGUACCUCCAACA | 132 | mU*mC*mU*mG*mC*mC*mA*mG*mA*mG*mC*mA*mG*mG*mU*mA*mC*mC*mU*mC*mC*mA*mA*mC*mA | 495 | XXXXXXXXXXXXXXXXXXXXXXXX | 25-mer 2'-OMethyl | DMD |
| WV-2236 | AUCUGCCAGAGCAGGUACCUCCAAC | 133 | mA*mU*mC*mU*mG*mC*mC*mA*mG*mA*mG*mC*mA*mG*mG*mU*mA*mC*mC*mU*mC*mC*mA*mA*mC | 496 | XXXXXXXXXXXXXXXXXXXXXXXX | 25-mer 2'-OMethyl | DMD |
| WV-2237 | AAUCUGCCAGAGCAGGUACCUCCAA | 134 | mA*mA*mU*mC*mU*mG*mC*mC*mA*mG*mA*mG*mC*mA*mG*mG*mU*mA*mC*mC*mU*mC*mC*mA*mA | 497 | XXXXXXXXXXXXXXXXXXXXXXX | 25-mer 2'-OMethyl | DMD |
| WV-2238 | AAAUCUGCCAGAGCAGGUACCUCCA | 135 | mA*mA*mA*mU*mC*mU*mG*mC*mC*mA*mG*mA*mG*mC*mA*mG*mG*mU*mA*mC*mC*mU*mC*mC*mA | 498 | XXXXXXXXXXXXXXXXXXXXXXXX | 25-mer 2'-OMethyl | DMD |

TABLE 4-continued

| Example Oligonucleotides | | | | | | | |
|---|---|---|---|---|---|---|---|
| WAVE ID | Base Sequence | SEQ ID NO: | Description | SEQ ID NO: | Stereochemistry[1] | Notes | Target/Program |
| WV-2239 | GAAAUCUGCCAGAGCAGGUACCUCC | 136 | mG*mA*mA*mA*mU*mC*mU*mG*mC*mC*mA*mG*mA*mG*mC*mA*mG*mG*mU*mA*mC*mC*mU*mC*mC | 499 | XXXXXXXXXXXXXXXXXXXXXXXX | 25-mer 2'-OMethyl | DMD |
| WV-2240 | UGAAAUCUGCCAGAGCAGGUACCUC | 137 | mU*mG*mA*mA*mA*mU*mC*mU*mG*mC*mC*mA*mG*mA*mG*mC*mA*mG*mG*mU*mA*mC*mC*mU*mC | 500 | XXXXXXXXXXXXXXXXXXXXXXXX | 25-mer 2'-OMethyl | DMD |
| WV-2241 | UUGAAAUCUGCCAGAGCAGGUACCU | 138 | mU*mU*mG*mA*mA*mA*mU*mC*mU*mG*mC*mC*mA*mG*mA*mG*mC*mA*mG*mG*mU*mA*mC*mC*mU | 501 | XXXXXXXXXXXXXXXXXXXXXXXX | 25-mer 2'-OMethyl | DMD |
| WV-2242 | CCCGGUUGAAAUCUGCCAGAGCAGG | 139 | mC*mC*mC*mG*mG*mU*mU*mG*mA*mA*mA*mU*mC*mU*mG*mC*mC*mA*mG*mA*mG*mC*mA*mG*mG | 502 | XXXXXXXXXXXXXXXXXXXXXXXX | 25-mer 2'-OMethyl | DMD |
| WV-2243 | CCAAGCCCGGUUGAAAUCUGCCAGA | 140 | mC*mC*mA*mA*mG*mC*mC*mC*mG*mG*mU*mU*mG*mA*mA*mA*mU*mC*mU*mG*mC*mC*mA*mG*mA | 503 | XXXXXXXXXXXXXXXXXXXXXXXX | 25-mer 2'-OMethyl | DMD |
| WV-2244 | UCCAAGCCCGGUUGAAAUCUGCCAG | 141 | mU*mC*mC*mA*mA*mG*mC*mC*mC*mG*mG*mU*mU*mG*mA*mA*mA*mU*mC*mU*mG*mC*mC*mA*mG | 504 | XXXXXXXXXXXXXXXXXXXXXXXX | 25-mer 2'-OMethyl | DMD |
| WV-2245 | GUCCAAGCCCGGUUGAAAUCUGCCA | 142 | mG*mU*mC*mC*mA*mA*mG*mC*mC*mC*mG*mG*mU*mU*mG*mA*mA*mA*mU*mC*mU*mG*mC*mC*mA | 505 | XXXXXXXXXXXXXXXXXXXXXXXX | 25-mer 2'-OMethyl | DMD |
| WV-2246 | UCUGUCCAAGCCCGGUUGAAAUCUG | 143 | mU*mC*mU*mG*mU*mC*mC*mA*mA*mG*mC*mC*mC*mG*mG*mU*mU*mG*mA*mA*mA*mU*mC*mU*mG | 506 | XXXXXXXXXXXXXXXXXXXXXXXX | 25-mer 2'-OMethyl | DMD |
| WV-2247 | UUCUGUCCAAGCCCGGUUGAAAUCU | 144 | mU*mU*mC*mU*mG*mU*mC*mC*mA*mA*mG*mC*mC*mC*mG*mG*mU*mU*mG*mA*mA*mA*mU*mC*mU | 507 | XXXXXXXXXXXXXXXXXXXXXXXX | 25-mer 2'-OMethyl | DMD |

TABLE 4-continued

Example Oligonucleotides

| WAVE ID | Base Sequence | SEQ ID NO: | Description | SEQ ID NO: | Stereochemistry[1] | Notes | Target/Program |
|---|---|---|---|---|---|---|---|
| WV-2248 | GUUCUGUCCAAGCCCGGUUGAAAUC | 145 | mG*mU*mU*mC*mU*mG*mU*mC*mC*mA*mA*mG*mC*mC*mC*mG*mG*mU*mU*mG*mA*mA*mA*mU*mC | 508 | XXXXXXXXXXXXXXXXXXXXXXXX | 25-mer 2'-OMethyl | DMD |
| WV-2249 | AGUUCUGUCCAAGCCCGGUUGAAAU | 146 | mA*mG*mU*mU*mC*mU*mG*mU*mC*mC*mA*mA*mG*mC*mC*mC*mG*mG*mU*mU*mG*mA*mA*mA*mU | 509 | XXXXXXXXXXXXXXXXXXXXXXXX | 25-mer 2'-OMethyl | DMD |
| WV-2250 | AAGUUCUGUCCAAGCCCGGUUGAAA | 147 | mA*mA*mG*mU*mU*mC*mU*mG*mU*mC*mC*mA*mA*mG*mC*mC*mC*mG*mG*mU*mU*mG*mA*mA*mA | 510 | XXXXXXXXXXXXXXXXXXXXXXXX | 25-mer 2'-OMethyl | DMD |
| WV-2251 | UAAGUUCUGUCCAAGCCCGGUUGAA | 148 | mU*mA*mA*mG*mU*mU*mC*mU*mG*mU*mC*mC*mA*mA*mG*mC*mC*mC*mG*mG*mU*mU*mG*mA*mA | 511 | XXXXXXXXXXXXXXXXXXXXXXXX | 25-mer 2'-OMethyl | DMD |
| WV-2252 | GUAAGUUCUGUCCAAGCCCGGUUGA | 149 | mG*mU*mA*mA*mG*mU*mU*mC*mU*mG*mU*mC*mC*mA*mA*mG*mC*mC*mC*mG*mG*mU*mU*mG*mA | 512 | XXXXXXXXXXXXXXXXXXXXXXXX | 25-mer 2'-OMethyl | DMD |
| WV-2253 | GGUAAGUUCUGUCCAAGCCCGGUUG | 150 | mG*mG*mU*mA*mA*mG*mU*mU*mC*mU*mG*mU*mC*mC*mA*mA*mG*mC*mC*mC*mG*mG*mU*mU*mG | 513 | XXXXXXXXXXXXXXXXXXXXXXXX | 25-mer 2'-OMethyl | DMD |
| WV-2254 | CGGUAAGUUCUGUCCAAGCCCGGUU | 151 | mC*mG*mG*mU*mA*mA*mG*mU*mU*mC*mU*mG*mU*mC*mC*mA*mA*mG*mC*mC*mC*mG*mG*mU*mU | 514 | XXXXXXXXXXXXXXXXXXXXXXXX | 25-mer 2'-OMethyl | DMD |
| WV-2255 | UCGGUAAGUUCUGUCCAAGCCCGGU | 152 | mU*mC*mG*mG*mU*mA*mA*mG*mU*mU*mC*mU*mG*mU*mC*mC*mA*mA*mG*mC*mC*mC*mG*mG*mU | 515 | XXXXXXXXXXXXXXXXXXXXXXXX | 25-mer 2'-OMethyl | DMD |
| WV-2256 | GUCGGUAAGUUCUGUCCAAGCCCGG | 153 | mG*mU*mC*mG*mG*mU*mA*mA*mG*mU*mU*mC*mU*mG*mU*mC*mC*mA*mA*mG*mC*mC*mC*mG*mG | 516 | XXXXXXXXXXXXXXXXXXXXXXXX | 25-mer 2'-OMethyl | DMD |

TABLE 4-continued

| Example Oligonucleotides | | | | | | | |
|---|---|---|---|---|---|---|---|
| WAVE ID | Base Sequence | SEQ ID NO: | Description | SEQ ID NO: | Stereochemistry[1] | Notes | Target/Program |
| WV-2257 | AGUCGGUAAGUUCUGUCCAAGCCCG | 154 | mA*mG*mU*mC*mG*mG*mU*mA*mA*mG*mU*mU*mC*mU*mG*mU*mC*mC*mA*mA*mG*mC*mC*mC*mG | 517 | XXXXXXXXXXXXXXXXXXXXXXXX | 25-mer 2'-OMethyl | DMD |
| WV-2258 | CAGUCGGUAAGUUCUGUCCAAGCCC | 155 | mC*mA*mG*mU*mC*mG*mG*mU*mA*mA*mG*mU*mU*mC*mU*mG*mU*mC*mC*mA*mA*mG*mC*mC*mC | 518 | XXXXXXXXXXXXXXXXXXXXXXXX | 25-mer 2'-OMethyl | DMD |
| WV-2259 | AAAGCCAGUCGGUAAGUUCUGUCCA | 156 | mA*mA*mA*mG*mC*mC*mA*mG*mU*mC*mG*mG*mU*mA*mA*mG*mU*mU*mC*mU*mG*mU*mC*mC*mA | 519 | XXXXXXXXXXXXXXXXXXXXXXXX | 25-mer 2'-OMethyl | DMD |
| WV-2260 | GAAAGCCAGUCGGUAAGUUCUGUCC | 157 | mG*mA*mA*mA*mG*mC*mC*mA*mG*mU*mC*mG*mG*mU*mA*mA*mG*mU*mU*mC*mU*mG*mU*mC*mC | 520 | XXXXXXXXXXXXXXXXXXXXXXXX | 25-mer 2'-OMethyl | DMD |
| WV-2261 | GUCACCCACCAUCACCCUCUGUGAU | 158 | mG*mU*mC*mA*mC*mC*mC*mA*mC*mC*mA*mU*mC*mA*mC*mC*mC*mU*mC*mU*mG*mU*mG*mA*mU | 521 | XXXXXXXXXXXXXXXXXXXXXXXX | 25-mer 2'-OMethyl | DMD |
| WV-2262 | GGUCACCCACCAUCACCCUCUGUGA | 159 | mG*mG*mU*mC*mA*mC*mC*mC*mA*mC*mC*mA*mU*mC*mA*mC*mC*mC*mU*mC*mU*mG*mU*mG*mA | 522 | XXXXXXXXXXXXXXXXXXXXXXXX | 25-mer 2'-OMethyl | DMD |
| WV-2263 | AAGGUCACCCACCAUCACCCUCUGU | 160 | mA*mA*mG*mG*mU*mC*mA*mC*mC*mC*mA*mC*mC*mA*mU*mC*mA*mC*mC*mC*mU*mC*mU*mG*mU | 523 | XXXXXXXXXXXXXXXXXXXXXXXX | 25-mer 2'-OMethyl | DMD |
| WV-2264 | CAAGGUCACCCACCAUCACCCUCUG | 161 | mC*mA*mA*mG*mG*mU*mC*mA*mC*mC*mC*mA*mC*mC*mA*mU*mC*mA*mC*mC*mC*mU*mC*mU*mG | 524 | XXXXXXXXXXXXXXXXXXXXXXXX | 25-mer 2'-OMethyl | DMD |
| WV-2265 | UCAAGGUCACCCACCAUCACCCUCU | 162 | mU*mC*mA*mA*mG*mG*mU*mC*mA*mC*mC*mC*mA*mC*mC*mA*mU*mC*mA*mC*mC*mC*mU*mC*mU | 525 | XXXXXXXXXXXXXXXXXXXXXXXX | 25-mer 2'-OMethyl | DMD |

TABLE 4-continued

| Example Oligonucleotides | | | | | | | |
|---|---|---|---|---|---|---|---|
| WAVE ID | Base Sequence | SEQ ID NO: | Description | SEQ ID NO: | Stereochemistry[1] | Notes | Target/Program |
| WV-2266 | CUCAAGGUCACCCACCAUCACCCUC | 163 | mC*mU*mC*mA*mA*mG*mG*mU*mC*mA*mC*mC*mC*mA*mC*mC*mA*mU*mC*mA*mC*mC*mC*mU*mC | 526 | XXXXXXXXXXXXXXXXXXXXXXXX | 25-mer 2'-OMethyl | DMD |
| WV-2267 | CUUGAUCAAGCAGAGAAAGCCAGUC | 164 | mC*mU*mU*mG*mA*mU*mC*mA*mA*mG*mC*mA*mG*mA*mG*mA*mA*mA*mG*mC*mC*mA*mG*mU*mC | 527 | XXXXXXXXXXXXXXXXXXXXXXXX | 25-mer 2'-OMethyl | DMD |
| WV-2268 | AUAACUUGAUCAAGCAGAGAAAGCC | 165 | mA*mU*mA*mA*mC*mU*mU*mG*mA*mU*mC*mA*mA*mG*mC*mA*mG*mA*mG*mA*mA*mA*mG*mC*mC | 528 | XXXXXXXXXXXXXXXXXXXXXXXX | 25-mer 2'-OMethyl | DMD |
| WV-2273 | AGUAACAGUCUGAGUAGGAG | 166 | mA*mG*mU*mA*mA*mC*mA*mG*mU*mC*mU*mG*mA*mG*mU*mA*mG*mG*mA*mG | 529 | XXXXXXXXXXXXXXXXXXX | 20-mer 2'-OMethyl | DMD |
| WV-2274 | GAGUAACAGUCUGAGUAGGA | 167 | mG*mA*mG*mU*mA*mA*mC*mA*mG*mU*mC*mU*mG*mA*mG*mU*mA*mG*mG*mA | 530 | XXXXXXXXXXXXXXXXXXX | 20-mer 2'-OMethyl | DMD |
| WV-2275 | AGAGUAACAGUCUGAGUAGG | 168 | mA*mG*mA*mG*mU*mA*mA*mC*mA*mG*mU*mC*mU*mG*mA*mG*mU*mA*mG*mG | 531 | XXXXXXXXXXXXXXXXXXX | 20-mer 2'-OMethyl | DMD |
| WV-2276 | CAGAGUAACAGUCUGAGUAG | 169 | mC*mA*mG*mA*mG*mU*mA*mA*mC*mA*mG*mU*mC*mU*mG*mA*mG*mU*mA*mG | 532 | XXXXXXXXXXXXXXXXXXX | 20-mer 2'-OMethyl | DMD |
| WV-2277 | GUCACCAGAGUAACAGUCUG | 170 | mG*mU*mC*mA*mC*mC*mA*mG*mA*mG*mU*mA*mA*mC*mA*mG*mU*mC*mU*mG | 533 | XXXXXXXXXXXXXXXXXXX | 20-mer 2'-OMethyl | DMD |
| WV-2278 | UGUCACCAGAGUAACAGUCU | 171 | mU*mG*mU*mC*mA*mC*mC*mA*mG*mA*mG*mU*mA*mA*mC*mA*mG*mU*mC*mU | 534 | XXXXXXXXXXXXXXXXXXX | 20-mer 2'-OMethyl | DMD |
| WV-2279 | GUGUCACCAGAGUAACAGUC | 172 | mG*mU*mG*mU*mC*mA*mC*mC*mA*mG*mA*mG*mU*mA*mA*mC*mA*mG*mU*mC | 535 | XXXXXXXXXXXXXXXXXXX | 20-mer 2'-OMethyl | DMD |
| WV-2280 | UGUGUCACCAGAGUAACAGU | 173 | mU*mG*mU*mG*mU*mC*mA*mC*mC*mA*mG*mA*mG*mU*mA*mA*mC*mA*mG*mU | 536 | XXXXXXXXXXXXXXXXXXX | 20-mer 2'-OMethyl | DMD |

TABLE 4-continued

Example Oligonucleotides

| WAVE ID | Base Sequence | SEQ ID NO: | Description | SEQ ID NO: | Stereochemistry[1] | Notes | Target/Program |
|---|---|---|---|---|---|---|---|
| WV-2281 | UUGUGUCACCAGAGUAACAG | 174 | mU*mU*mG*mU*mG*mU*mC*mA*mC*mC*mA*mG*mA*mG*mU*mA*mA*mC*mA*mG | 537 | XXXXXXXXXXXXXXXXXXX | 20-mer 2'-OMethyl | DMD |
| WV-2282 | GGUUGUGUCACCAGAGUAAC | 175 | mG*mG*mU*mU*mG*mU*mG*mU*mC*mA*mC*mC*mA*mG*mA*mG*mU*mA*mA*mC | 538 | XXXXXXXXXXXXXXXXXXX | 20-mer 2'-OMethyl | DMD |
| WV-2283 | AGGUUGUGUCACCAGAGUAA | 176 | mA*mG*mG*mU*mU*mG*mU*mG*mU*mC*mA*mC*mC*mA*mG*mA*mG*mU*mA*mA | 539 | XXXXXXXXXXXXXXXXXXX | 20-mer 2'-OMethyl | DMD |
| WV-2284 | CAGGUUGUGUCACCAGAGUA | 177 | mC*mA*mG*mG*mU*mU*mG*mU*mG*mU*mC*mA*mC*mC*mA*mG*mA*mG*mU*mA | 540 | XXXXXXXXXXXXXXXXXXX | 20-mer 2'-OMethyl | DMD |
| WV-2285 | ACAGGUUGUGUCACCAGAGU | 178 | mA*mC*mA*mG*mG*mU*mU*mG*mU*mG*mU*mC*mA*mC*mC*mA*mG*mA*mG*mU | 541 | XXXXXXXXXXXXXXXXXXX | 20-mer 2'-OMethyl | DMD |
| WV-2286 | CACAGGUUGUGUCACCAGAG | 179 | mC*mA*mC*mA*mG*mG*mU*mU*mG*mU*mG*mU*mC*mA*mC*mC*mA*mG*mA*mG | 542 | XXXXXXXXXXXXXXXXXXX | 20-mer 2'-OMethyl | DMD |
| WV-2287 | CCACAGGUUGUGUCACCAGA | 180 | mC*mC*mA*mC*mA*mG*mG*mU*mU*mG*mU*mG*mU*mC*mA*mC*mC*mA*mG*mA | 543 | XXXXXXXXXXXXXXXXXXX | 20-mer 2'-OMethyl | DMD |
| WV-2288 | ACCACAGGUUGUGUCACCAG | 181 | mA*mC*mC*mA*mC*mA*mG*mG*mU*mU*mG*mU*mG*mU*mC*mA*mC*mC*mA*mG | 544 | XXXXXXXXXXXXXXXXXXX | 20-mer 2'-OMethyl | DMD |
| WV-2289 | AACCACAGGUUGUGUCACCA | 182 | mA*mA*mC*mC*mA*mC*mA*mG*mG*mU*mU*mG*mU*mG*mU*mC*mA*mC*mC*mA | 545 | XXXXXXXXXXXXXXXXXXX | 20-mer 2'-OMethyl | DMD |
| WV-2290 | UAACCACAGGUUGUGUCACC | 183 | mU*mA*mA*mC*mC*mA*mC*mA*mG*mG*mU*mU*mG*mU*mG*mU*mC*mA*mC*mC | 546 | XXXXXXXXXXXXXXXXXXX | 20-mer 2'-OMethyl | DMD |
| WV-2291 | GUAACCACAGGUUGUGUCAC | 184 | mG*mU*mA*mA*mC*mC*mA*mC*mA*mG*mG*mU*mU*mG*mU*mG*mU*mC*mA*mC | 547 | XXXXXXXXXXXXXXXXXXX | 20-mer 2'-OMethyl | DMD |
| WV-2292 | AGUAACCACAGGUUGUGUCA | 185 | mA*mG*mU*mA*mA*mC*mC*mA*mC*mA*mG*mG*mU*mU*mG*mU*mG*mU*mC*mA | 548 | XXXXXXXXXXXXXXXXXXX | 20-mer 2'-OMethyl | DMD |

TABLE 4-continued

Example Oligonucleotides

| WAVE ID | Base Sequence | SEQ ID NO: | Description | SEQ ID NO: | Stereochemistry[1] | Notes | Target/Program |
|---|---|---|---|---|---|---|---|
| WV-2293 | CUUAGUAACCACAGGUUGUG | 186 | mC*mU*mU*mA*mG*mU*mA*mA*mC*mC*mA*mC*mA*mG*mG*mU*mU*mG*mU*mG | 549 | XXXXXXXXXXXXXXXXXXX | 20-mer 2'-OMethyl | DMD |
| WV-2294 | CCUUAGUAACCACAGGUUGU | 187 | mC*mC*mU*mU*mA*mG*mU*mA*mA*mC*mC*mA*mC*mA*mG*mG*mU*mU*mG*mU | 550 | XXXXXXXXXXXXXXXXXXX | 20-mer 2'-OMethyl | DMD |
| WV-2295 | UCCUUAGUAACCACAGGUUG | 188 | *mA*mC*mC*mU*mU*mA*mG*mU*mA*mA*mC*mC*mA*mC*mA*mG*mG*mU*mU*mG | 551 | XXXXXXXXXXXXXXXXXXX | 20-mer 2'-OMethyl | DMD |
| WV-2296 | UUCCUUAGUAACCACAGGUU | 189 | mU*mU*mC*mC*mU*mU*mA*mG*mU*mA*mA*mC*mC*mA*mC*mA*mG*mG*mU*mU | 552 | XXXXXXXXXXXXXXXXXXX | 20-mer 2'-OMethyl | DMD |
| WV-2297 | UUUCCUUAGUAACCACAGGU | 190 | mU*mU*mU*mC*mC*mU*mU*mA*mG*mU*mA*mA*mC*mC*mA*mC*mA*mG*mG*mU | 553 | XXXXXXXXXXXXXXXXXXX | 20-mer 2'-OMethyl | DMD |
| WV-2298 | GUUUCCUUAGUAACCACAGG | 191 | mG*mU*mU*mU*mC*mC*mU*mU*mA*mG*mU*mA*mA*mC*mC*mA*mC*mA*mG*mG | 554 | XXXXXXXXXXXXXXXXXXX | 20-mer 2'-OMethyl | DMD |
| WV-2299 | AGUUUCCUUAGUAACCACAG | 192 | mA*mG*mU*mU*mU*mC*mC*mU*mU*mA*mG*mU*mA*mA*mC*mC*mA*mC*mA*mG | 555 | XXXXXXXXXXXXXXXXXXX | 20-mer 2'-OMethyl | DMD |
| WV-2300 | GCAGUUUCCUUAGUAACCAC | 193 | mG*mC*mA*mG*mU*mU*mU*mC*mC*mU*mU*mA*mG*mU*mA*mA*mC*mC*mA*mC | 556 | XXXXXXXXXXXXXXXXXXX | 20-mer 2'-OMethyl | DMD |
| WV-2301 | GGCAGUUUCCUUAGUAACCA | 194 | mG*mG*mC*mA*mG*mU*mU*mU*mC*mC*mU*mU*mA*mG*mU*mA*mA*mC*mC*mA | 557 | XXXXXXXXXXXXXXXXXXX | 20-mer 2'-OMethyl | DMD |
| WV-2302 | UGGCAGUUUCCUUAGUAACC | 195 | mU*mG*mG*mC*mA*mG*mU*mU*mU*mC*mC*mU*mU*mA*mG*mU*mA*mA*mC*mC | 558 | XXXXXXXXXXXXXXXXXXX | 20-mer 2'-OMethyl | DMD |
| WV-2303 | AUGGCAGUUUCCUUAGUAAC | 196 | mA*mU*mG*mG*mC*mA*mG*mU*mU*mU*mC*mC*mU*mU*mA*mG*mU*mA*mA*mC | 559 | XXXXXXXXXXXXXXXXXXX | 20-mer 2'-OMethyl | DMD |
| WV-2304 | GAUGGCAGUUUCCUUAGUAA | 197 | mG*mA*mU*mG*mG*mC*mA*mG*mU*mU*mU*mC*mC*mU*mU*mA*mG*mU*mA*mA | 560 | XXXXXXXXXXXXXXXXXXX | 20-mer 2'-OMethyl | DMD |

TABLE 4-continued

| Example Oligonucleotides | | | | | | | |
|---|---|---|---|---|---|---|---|
| WAVE ID | Base Sequence | SEQ ID NO: | Description | SEQ ID NO: | Stereochemistry[1] | Notes | Target/Program |
| WV-2305 | AGAUGGCAGUUUCCUUAGUA | 198 | mA*mG*mA*mU*mG*mG*mC*mA*mG*mU*mU*mU*mC*mC*mU*mU*mA*mG*mU*mA | 561 | XXXXXXXXXXXXXXXXXXX | 20-mer 2'-OMethyl | DMD |
| WV-2306 | GGAGAUGGCAGUUUCCUUAG | 199 | mG*mG*mA*mG*mA*mU*mG*mG*mC*mA*mG*mU*mU*mU*mC*mC*mU*mU*mA*mG | 562 | XXXXXXXXXXXXXXXXXXX | 20-mer 2'-OMethyl | DMD |
| WV-2307 | UGGAGAUGGCAGUUUCCUUA | 200 | mU*mG*mG*mA*mG*mA*mU*mG*mG*mC*mA*mG*mU*mU*mU*mC*mC*mU*mU*mA | 563 | XXXXXXXXXXXXXXXXXXX | 20-mer 2'-OMethyl | DMD |
| WV-2308 | UUGGAGAUGGCAGUUUCCUU | 201 | mU*mU*mG*mG*mA*mG*mA*mU*mG*mG*mC*mA*mG*mU*mU*mU*mC*mC*mU*mU | 564 | XXXXXXXXXXXXXXXXXXX | 20-mer 2'-OMethyl | DMD |
| WV-2309 | UUUGGAGAUGGCAGUUUCCU | 202 | mU*mU*mU*mG*mG*mA*mG*mA*mU*mG*mG*mC*mA*mG*mU*mU*mU*mC*mC*mU | 565 | XXXXXXXXXXXXXXXXXXX | 20-mer 2'-OMethyl | DMD |
| WV-2310 | GUUUGGAGAUGGCAGUUUCC | 203 | mG*mU*mU*mU*mG*mG*mA*mG*mA*mU*mG*mG*mC*mA*mG*mU*mU*mU*mC*mC | 566 | XXXXXXXXXXXXXXXXXXX | 20-mer 2'-OMethyl | DMD |
| WV-2311 | CUAGUUUGGAGAUGGCAGUU | 204 | mC*mU*mA*mG*mU*mU*mU*mG*mG*mA*mG*mA*mU*mG*mG*mC*mA*mG*mU*mU | 567 | XXXXXXXXXXXXXXXXXXX | 20-mer 2'-OMethyl | DMD |
| WV-2312 | UCUAGUUUGGAGAUGGCAGU | 205 | mU*mC*mU*mA*mG*mU*mU*mU*mG*mG*mA*mG*mA*mU*mG*mG*mC*mA*mG*mU | 568 | XXXXXXXXXXXXXXXXXXX | 20-mer 2'-OMethyl | DMD |
| WV-2313 | AUUUCUAGUUUGGAGAUGGC | 206 | mA*mU*mU*mU*mC*mU*mA*mG*mU*mU*mU*mG*mG*mA*mG*mA*mU*mG*mG*mC | 569 | XXXXXXXXXXXXXXXXXXX | 20-mer 2'-OMethyl | DMD |
| WV-2314 | UGGCAUUUCUAGUUUGGAGA | 207 | mU*mG*mG*mC*mA*mU*mU*mU*mC*mU*mA*mG*mU*mU*mU*mG*mG*mA*mG*mA | 570 | XXXXXXXXXXXXXXXXXXX | 20-mer 2'-OMethyl | DMD |
| WV-2315 | GAUGGCAUUUCUAGUUUGGA | 208 | mG*mA*mU*mG*mG*mC*mA*mU*mU*mU*mC*mU*mA*mG*mU*mU*mU*mG*mG*mA | 571 | XXXXXXXXXXXXXXXXXXX | 20-mer 2'-OMethyl | DMD |
| WV-2316 | AGAUGGCAUUUCUAGUUUGG | 209 | mA*mG*mA*mU*mG*mG*mC*mA*mU*mU*mU*mC*mU*mA*mG*mU*mU*mU*mG*mG | 572 | XXXXXXXXXXXXXXXXXXX | 20-mer 2'-OMethyl | DMD |

TABLE 4-continued

| Example Oligonucleotides | | | | | | | |
|---|---|---|---|---|---|---|---|
| WAVE ID | Base Sequence | SEQ ID NO: | Description | SEQ ID NO: | Stereochemistry[1] | Notes | Target/Program |
| WV-2317 | AAGAUGGCAUUUCUAGUUUG | 210 | mA*mA*mG*mA*mU*mG*mG*mC*mA*mU*mU*mU*mC*mU*mA*mG*mU*mU*mU*mG | 573 | XXXXXXXXXXXXXXXXXXX | 20-mer 2'-OMethyl | DMD |
| WV-2318 | AGGAAGAUGGCAUUUCUAGU | 211 | mA*mG*mG*mA*mA*mG*mA*mU*mG*mG*mC*mA*mU*mU*mU*mC*mU*mA*mG*mU | 574 | XXXXXXXXXXXXXXXXXXX | 20-mer 2'-OMethyl | DMD |
| WV-2319 | AAGGAAGAUGGCAUUUCUAG | 212 | mA*mA*mG*mG*mA*mA*mG*mA*mU*mG*mG*mC*mA*mU*mU*mU*mC*mU*mA*mG | 575 | XXXXXXXXXXXXXXXXXXX | 20-mer 2'-OMethyl | DMD |
| WV-2320 | CAAGGAAGAUGGCAUUUCUA | 213 | mC*mA*mA*mG*mG*mA*mA*mG*mA*mU*mG*mG*mC*mA*mU*mU*mU*mC*mU*mA | 576 | XXXXXXXXXXXXXXXXXXX | 20-mer 2'-OMethyl | DMD |
| WV-2321 | UCAAGGAAGAUGGCAUUUCU | 54 | mU*mC*mA*mA*mG*mG*mA*mA*mG*mA*mU*mG*mG*mC*mA*mU*mU*mU*mC*mU | 577 | XXXXXXXXXXXXXXXXXXX | 20-mer 2'-OMethyl | DMD |
| WV-2322 | ACAUCAAGGAAGAUGGCAUU | 214 | mA*mC*mA*mU*mC*mA*mA*mG*mG*mA*mA*mG*mA*mU*mG*mG*mC*mA*mU*mU | 578 | XXXXXXXXXXXXXXXXXXX | 20-mer 2'-OMethyl | DMD |
| WV-2323 | CAACAUCAAGGAAGAUGGCA | 215 | mC*mA*mA*mC*mA*mU*mC*mA*mA*mG*mG*mA*mA*mG*mA*mU*mG*mG*mC*mA | 579 | XXXXXXXXXXXXXXXXXXX | 20-mer 2'-OMethyl | DMD |
| WV-2324 | UCCAACAUCAAGGAAGAUGG | 216 | mU*mC*mC*mA*mA*mC*mA*mU*mC*mA*mA*mG*mG*mA*mA*mG*mA*mU*mG*mG | 580 | XXXXXXXXXXXXXXXXXXX | 20-mer 2'-OMethyl | DMD |
| WV-2325 | CCUCCAACAUCAAGGAAGAU | 217 | mC*mC*mU*mC*mC*mA*mA*mC*mA*mU*mC*mA*mA*mG*mG*mA*mA*mG*mA*mU | 581 | XXXXXXXXXXXXXXXXXXX | 20-mer 2'-OMethyl | DMD |
| WV-2326 | AGGUACCUCCAACAUCAAGG | 218 | mA*mG*mG*mU*mA*mC*mC*mU*mC*mC*mA*mA*mC*mA*mU*mC*mA*mA*mG*mG | 582 | XXXXXXXXXXXXXXXXXXX | 20-mer 2'-OMethyl | DMD |
| WV-2327 | CAGGUACCUCCAACAUCAAG | 219 | mC*mA*mG*mG*mU*mA*mC*mC*mU*mC*mC*mA*mA*mC*mA*mU*mC*mA*mA*mG | 583 | XXXXXXXXXXXXXXXXXXX | 20-mer 2'-OMethyl | DMD |
| WV-2328 | AGAGCAGGUACCUCCAACAU | 220 | mA*mG*mA*mG*mC*mA*mG*mG*mU*mA*mC*mC*mU*mC*mC*mA*mA*mC*mA*mU | 584 | XXXXXXXXXXXXXXXXXXX | 20-mer 2'-OMethyl | DMD |

TABLE 4-continued

| Example Oligonucleotides | | | | | | | |
|---|---|---|---|---|---|---|---|
| WAVE ID | Base Sequence | SEQ ID NO: | Description | SEQ ID NO: | Stereochemistry[1] | Notes | Target/Program |
| WV-2329 | CAGAGCAGGUACCUCCAACA | 221 | mC*mA*mG*mA*mG*mC*mA*mG*mG*mU*mA*mC*mC*mU*mC*mC*mA*mA*mC*mA | 585 | XXXXXXXXXXXXXXXXXXX | 20-mer 2'-OMethyl | DMD |
| WV-2330 | CCAGAGCAGGUACCUCCAAC | 222 | mC*mC*mA*mG*mA*mG*mC*mA*mG*mG*mU*mA*mC*mC*mU*mC*mC*mA*mA*mC | 586 | XXXXXXXXXXXXXXXXXXX | 20-mer 2'-OMethyl | DMD |
| WV-2331 | GCCAGAGCAGGUACCUCCAA | 223 | mG*mC*mC*mA*mG*mA*mG*mC*mA*mG*mG*mU*mA*mC*mC*mU*mC*mC*mA*mA | 587 | XXXXXXXXXXXXXXXXXXX | 20-mer 2'-OMethyl | DMD |
| WV-2332 | UGCCAGAGCAGGUACCUCCA | 224 | mU*mG*mC*mC*mA*mG*mA*mG*mC*mA*mG*mG*mU*mA*mC*mC*mU*mC*mC*mA | 588 | XXXXXXXXXXXXXXXXXXX | 20-mer 2'-OMethyl | DMD |
| WV-2333 | CUGCCAGAGCAGGUACCUCC | 225 | mC*mU*mG*mC*mC*mA*mG*mA*mG*mC*mA*mG*mG*mU*mA*mC*mC*mU*mC*mC | 589 | XXXXXXXXXXXXXXXXXXX | 20-mer 2'-OMethyl | DMD |
| WV-2334 | UCUGCCAGAGCAGGUACCUC | 226 | mU*mC*mU*mG*mC*mC*mA*mG*mA*mG*mC*mA*mG*mG*mU*mA*mC*mC*mU*mC | 590 | XXXXXXXXXXXXXXXXXXX | 20-mer 2'-OMethyl | DMD |
| WV-2335 | AUCUGCCAGAGCAGGUACCU | 227 | mA*mU*mC*mU*mG*mC*mC*mA*mG*mA*mG*mC*mA*mG*mG*mU*mA*mC*mC*mU | 591 | XXXXXXXXXXXXXXXXXXX | 20-mer 2'-OMethyl | DMD |
| WV-2336 | UUGAAAUCUGCCAGAGCAGG | 228 | mU*mU*mG*mA*mA*mA*mU*mC*mU*mG*mC*mC*mA*mG*mA*mG*mC*mA*mG*mG | 592 | XXXXXXXXXXXXXXXXXXX | 20-mer 2'-OMethyl | DMD |
| WV-2337 | CCCGGUUGAAAUCUGCCAGA | 229 | mC*mC*mC*mG*mG*mU*mU*mG*mA*mA*mA*mU*mC*mU*mG*mC*mC*mA*mG*mA | 593 | XXXXXXXXXXXXXXXXXXX | 20-mer 2'-OMethyl | DMD |
| WV-2338 | GCCCGGUUGAAAUCUGCCAG | 230 | mG*mC*mC*mC*mG*mG*mU*mU*mG*mA*mA*mA*mU*mC*mU*mG*mC*mC*mA*mG | 594 | XXXXXXXXXXXXXXXXXXX | 20-mer 2'-OMethyl | DMD |
| WV-2339 | AGCCCGGUUGAAAUCUGCCA | 231 | mA*mG*mC*mC*mC*mG*mG*mU*mU*mG*mA*mA*mA*mU*mC*mU*mG*mC*mC*mA | 595 | XXXXXXXXXXXXXXXXXXX | 20-mer 2'-OMethyl | DMD |
| WV-2340 | CCAAGCCCGGUUGAAAUCUG | 232 | mC*mC*mA*mA*mG*mC*mC*mC*mG*mG*mU*mU*mG*mA*mA*mA*mU*mC*mU*mG | 596 | XXXXXXXXXXXXXXXXXXX | 20-mer 2'-OMethyl | DMD |

TABLE 4-continued

| Example Oligonucleotides | | | | | | | |
|---|---|---|---|---|---|---|---|
| WAVE ID | Base Sequence | SEQ ID NO: | Description | SEQ ID NO: | Stereochemistry[1] | Notes | Target/Program |
| WV-2341 | UCCAAGCCCGGUUGAAAUCU | 233 | mU*mC*mC*mA*mA*mG*mC*mC*mC*mG*mG*mU*mU*mG*mA*mA*mA*mU*mC*mU | 597 | XXXXXXXXXXXXXXXXXXX | 20-mer 2'-OMethyl | DMD |
| WV-2342 | GUCCAAGCCCGGUUGAAAUC | 234 | mG*mU*mC*mC*mA*mA*mG*mC*mC*mC*mG*mG*mU*mU*mG*mA*mA*mA*mU*mC | 598 | XXXXXXXXXXXXXXXXXXX | 20-mer 2'-OMethyl | DMD |
| WV-2343 | UGUCCAAGCCCGGUUGAAAU | 235 | mU*mG*mU*mC*mC*mA*mA*mG*mC*mC*mC*mG*mG*mU*mU*mG*mA*mA*mA*mU | 599 | XXXXXXXXXXXXXXXXXXX | 20-mer 2'-OMethyl | DMD |
| WV-2344 | CUGUCCAAGCCCGGUUGAAA | 236 | mC*mU*mG*mU*mC*mC*mA*mA*mG*mC*mC*mC*mG*mG*mU*mU*mG*mA*mA*mA | 600 | XXXXXXXXXXXXXXXXXXX | 20-mer 2'-OMethyl | DMD |
| WV-2345 | UCUGUCCAAGCCCGGUUGAA | 237 | mU*mC*mU*mG*mU*mC*mC*mA*mA*mG*mC*mC*mC*mG*mG*mU*mU*mG*mA*mA | 601 | XXXXXXXXXXXXXXXXXXX | 20-mer 2'-OMethyl | DMD |
| WV-2346 | UUCUGUCCAAGCCCGGUUGA | 238 | mU*mU*mC*mU*mG*mU*mC*mC*mA*mA*mG*mC*mC*mC*mG*mG*mU*mU*mG*mA | 602 | XXXXXXXXXXXXXXXXXXX | 20-mer 2'-OMethyl | DMD |
| WV-2347 | GUUCUGUCCAAGCCCGGUUG | 239 | mG*mU*mU*mC*mU*mG*mU*mC*mC*mA*mA*mG*mC*mC*mC*mG*mG*mU*mU*mG | 603 | XXXXXXXXXXXXXXXXXXX | 20-mer 2'-OMethyl | DMD |
| WV-2348 | AGUUCUGUCCAAGCCCGGUU | 240 | mA*mG*mU*mU*mC*mU*mG*mU*mC*mC*mA*mA*mG*mC*mC*mC*mG*mG*mU*mU | 604 | XXXXXXXXXXXXXXXXXXX | 20-mer 2'-OMethyl | DMD |
| WV-2349 | AAGUUCUGUCCAAGCCCGGU | 241 | mA*mA*mG*mU*mU*mC*mU*mG*mU*mC*mC*mA*mA*mG*mC*mC*mC*mG*mG*mU | 605 | XXXXXXXXXXXXXXXXXXX | 20-mer 2'-OMethyl | DMD |
| WV-2350 | UAAGUUCUGUCCAAGCCCGG | 242 | mU*mA*mA*mG*mU*mU*mC*mU*mG*mU*mC*mC*mA*mA*mG*mC*mC*mC*mG*mG | 606 | XXXXXXXXXXXXXXXXXXX | 20-mer 2'-OMethyl | DMD |
| WV-2351 | GUAAGUUCUGUCCAAGCCCG | 243 | mG*mU*mA*mA*mG*mU*mU*mC*mU*mG*mU*mC*mC*mA*mA*mG*mC*mC*mC*mG | 607 | XXXXXXXXXXXXXXXXXXX | 20-mer 2'-OMethyl | DMD |
| WV-2352 | GGUAAGUUCUGUCCAAGCCC | 244 | mG*mG*mU*mA*mA*mG*mU*mU*mC*mU*mG*mU*mC*mC*mA*mA*mG*mC*mC*mC | 608 | XXXXXXXXXXXXXXXXXXX | 20-mer 2'-OMethyl | DMD |

TABLE 4-continued

| Example Oligonucleotides | | | | | | | |
|---|---|---|---|---|---|---|---|
| WAVE ID | Base Sequence | SEQ ID NO: | Description | SEQ ID NO: | Stereochemistry[1] | Notes | Target/Program |
| WV-2353 | CAGUCGGUAAGUUCUGUCCA | 245 | mC*mA*mG*mU*mC*mG*mG*mU*mA*mA*mG*mU*mU*mC*mU*mG*mU*mC*mC*mA | 609 | XXXXXXXXXXXXXXXXXXX | 20-mer 2'-OMethyl | DMD |
| WV-2354 | CCAGUCGGUAAGUUCUGUCC | 246 | mC*mC*mA*mG*mU*mC*mG*mG*mU*mA*mA*mG*mU*mU*mC*mU*mG*mU*mC*mC | 610 | XXXXXXXXXXXXXXXXXXX | 20-mer 2'-OMethyl | DMD |
| WV-2355 | CCACCAUCACCCUCUGUGAU | 247 | mC*mC*mA*mC*mC*mA*mU*mC*mA*mC*mC*mC*mU*mC*mU*mG*mU*mG*mA*mU | 611 | XXXXXXXXXXXXXXXXXXX | 20-mer 2'-OMethyl | DMD |
| WV-2356 | CCCACCAUCACCCUCUGUGA | 248 | mC*mC*mC*mA*mC*mC*mA*mU*mC*mA*mC*mC*mC*mU*mC*mU*mG*mU*mG*mA | 612 | XXXXXXXXXXXXXXXXXXX | 20-mer 2'-OMethyl | DMD |
| WV-2357 | CACCCACCAUCACCCUCUGU | 249 | mC*mA*mC*mC*mC*mA*mC*mC*mA*mU*mC*mA*mC*mC*mC*mU*mC*mU*mG*mU | 613 | XXXXXXXXXXXXXXXXXXX | 20-mer 2'-OMethyl | DMD |
| WV-2358 | UCACCCACCAUCACCCUCUG | 250 | mU*mC*mA*mC*mC*mC*mA*mC*mC*mA*mU*mC*mA*mC*mC*mC*mU*mC*mU*mG | 614 | XXXXXXXXXXXXXXXXXXX | 20-mer 2'-OMethyl | DMD |
| WV-2359 | GUCACCCACCAUCACCCUCU | 251 | mG*mU*mC*mA*mC*mC*mC*mA*mC*mC*mA*mU*mC*mA*mC*mC*mC*mU*mC*mU | 615 | XXXXXXXXXXXXXXXXXXX | 20-mer 2'-OMethyl | DMD |
| WV-2360 | GGUCACCCACCAUCACCCUC | 252 | mG*mG*mU*mC*mA*mC*mC*mC*mA*mC*mC*mA*mU*mC*mA*mC*mC*mC*mU*mC | 616 | XXXXXXXXXXXXXXXXXXX | 20-mer 2'-OMethyl | DMD |
| WV-2361 | UCAAGCAGAGAAAGCCAGUC | 253 | mU*mC*mA*mA*mG*mC*mA*mG*mA*mG*mA*mA*mA*mG*mC*mC*mA*mG*mU*mC | 617 | XXXXXXXXXXXXXXXXXXX | 20-mer 2'-OMethyl | DMD |
| WV-2362 | UUGAUCAAGCAGAGAAAGCC | 254 | mU*mU*mG*mA*mU*mC*mA*mA*mG*mC*mA*mG*mA*mG*mA*mA*mA*mG*mC*mC | 618 | XXXXXXXXXXXXXXXXXXX | 20-mer 2'-OMethyl | DMD |
| WV-2625 | CAAAGAAGAUGGCAUUUCUAGUUUG | 255 | mC*mA*mA*mA*mG*mA*mA*mG*mA*mU*mG*mG*mC*mA*mU*mU*mU*mC*mU*mA*mG*mU*mU*mU*mG | 674 | XXXXXXXXXXXXXXXXXXXXXXXX | based on WV-2223 match mouse target sequence | DMD |
| WV-2627 | GCAAAGAAGAUGGCAUUUCU | 256 | mG*mC*mA*mA*mA*mG*mA*mA*mG*mA*mU*mG*mG*mC*mA*mU*mU*mU*mC*mU | 675 | XXXXXXXXXXXXXXXXXXX | based on WV-942 match mouse target sequence | DMD |

TABLE 4-continued

| Example Oligonucleotides | | | | | | | |
|---|---|---|---|---|---|---|---|
| WAVE ID | Base Sequence | SEQ ID NO: | Description | SEQ ID NO: | Stereochemistry[1] | Notes | Target/Program |
| WV-2628 | GCAAAGAAGAUGGCAUUUCU | 256 | fG*fC*fA*fA*fA*fG*mA*mA*mG*mA*mU*mG*mG*mC*fA*fU*fU*fU*fC*fU | 676 | XXXXXXXXXXXXXXXXXXX | based on WV-1714 match mouse target sequence | DMD |
| WV-2095 | UCAAGGAAGAUGGCAUUUCU | 54 | fU*fC*fA*fA*fG*mG*mA*mA*mG*mA*mU*mG*mG*mC*mA*fU*fU*fU*fC*fU | 423 | XXXXXXXXXXXXXXXXXXX | Exon51: 5F-10OMe-5F all-PS | DMD Exon51 |
| WV-2096 | UCAAGGAAGAUGGCAUUUCU | 54 | fU*fC*fA*fA*mG*mG*mA*mA*mG*mA*mU*mG*mG*mC*mA*mU*fU*fU*fC*f | 424 | XXXXXXXXXXXXXXXXXXX | Exon51: 4F-12OMe-4F all-PS | DMD Exon51 |
| WV-2097 | UCAAGGAAGAUGGCAUUUCU | 54 | fU*fC*fA*mA*mG*mG*mA*mA*mG*mA*mU*mG*mG*mC*mA*mU*mU*fU*fC*fU | 425 | XXXXXXXXXXXXXXXXXXX | Exon51: 3F-14OMe-3F all-PS | DMD Exon51 |
| WV-2098 | UCAAGGAAGAUGGCAUUUCU | 54 | fU*fC*mA*mA*mG*mG*mA*mA*mG*mA*mU*mG*mG*mC*mA*mU*mU*mU*fC*fU | 426 | XXXXXXXXXXXXXXXXXXX | Exon51: 2F-16OMe-2F all-PS | DMD Exon51 |
| WV-2099 | UCAAGGAAGAUGGCAUUUCU | 54 | fU*mC*mA*mA*mG*mG*mA*mA*mG*mA*mU*mG*mG*mC*mA*mU*mU*mU*mC*fU | 427 | XXXXXXXXXXXXXXXXXXX | Exon51: 1F-18OMe-1F all-PS | DMD Exon51 |
| WV-2100 | UCAAGGAAGAUGGCAUUUCU | 54 | fU*fC*fA*fA*fG*fGmA*mA*mG*mA*mU*mG*mG*mCfA*fU*fU*fU*fC*fU | 428 | XXXXXOXXXXXXXOXXXXX | Exon51: 6F-8OMe-6F 5PS-1PO-7PS-1PO-5PS | DMD Exon51 |
| WV-2101 | UCAAGGAAGAUGGCAUUUCU | 54 | fU*fC*fA*fA*fGfGmA*mA*mG*mA*mU*mG*mG*mCfAfU*fU*fU*fC*fU | 429 | XXXXOOXXXXXXXOOXXXX | Exon51: 6F-8OMe-6F 4PS-2PO-7PS-2PO-4PS | DMD Exon51 |
| WV-2102 | UCAAGGAAGAUGGCAUUUCU | 54 | fU*fC*fA*fAfGfGmA*mA*mG*mA*mU*mG*mG*mCfAfUfU*fU*fC*fU | 430 | XXXOOOXXXXXXXOOOXXX | Exon51: 6F-8OMe-6F 3PS-3PO-7PS-3PO-3PS | DMD Exon51 |
| WV-2103 | UCAAGGAAGAUGGCAUUUCU | 54 | fU*fC*fAfAfGfGmA*mA*mG*mA*mU*mG*mG*mCfAfUfUfU*fC*fU | 431 | XXOOOOXXXXXXXOOOOXX | Exon51: 6F-8OMe-6F 2PS-4PO-7PS-4PO-2PS | DMD Exon51 |
| WV-2104 | UCAAGGAAGAUGGCAUUUCU | 54 | fU*fCfAfAfGfGmA*mA*mG*mA*mU*mG*mG*mCfAfUfUfUfC*fU | 432 | XOOOOOXXXXXXXOOOOOX | Exon51: 6F-8OMe-6F 1PS-5PO-7PS-5PO-1PS | DMD Exon51 |
| WV-2105 | UCAAGGAAGAUGGCAUUUCU | 54 | fUfCfAfAfGfGmA*mA*mG*mA*mU*mG*mG*mCfAfUfUfUfCfU | 433 | OOOOOOXXXXXXXOOOOOO | Exon51: 6F-8OMe-6F 6PO-7PS-6PO | DMD Exon51 |

TABLE 4-continued

Example Oligonucleotides

| WAVE ID | Base Sequence | SEQ ID NO: | Description | SEQ ID NO: | Stereochemistry[1] | Notes | Target/Program |
|---|---|---|---|---|---|---|---|
| WV-2106 | UCAAGGA AGAUGGC AUUUCU | 54 | fU*fC*fA*fA*fG*fG*fA*fA*fG*fA*mU* mG*mG*mC*mA*mU*mU*mU*mC*mU | 434 | XXXXXXX XXXXXXX XXXXX | Exon51: 10E-10OMe all-PS | DMD Exon51 |
| WV-2107 | UCAAGGA AGAUGGC AUUUCU | 54 | mU*mC*mA*mA*mG*mG*mA*mA*mG *mA*fU*fG*fG*fC*fA*fU*fU*fU*fC*fU | 435 | XXXXXXX XXXXXXX XXXXX | Exon51: 10OMe-10F all-PS | DMD Exon51 |
| WV-2108 | UCAAGGA AGAUGGC AUUUCU | 54 | fU*fC*fA*fA*fG*fG*mA*mA*mG*mA* mU*mG*mG*mC*mA*mU*mU*mU*mC *mU | 436 | XXXXXXX XXXXXXX XXXXX | Exon51: 6F-14OMe all-PS | DMD Exon51 |
| WV-2109 | UCAAGGA AGAUGGC AUUUCU | 54 | mU*mC*mA*mA*mG*mG*mA*mA*mG *mA*mU*mG*mG*mC*fA*fU*fU*fU*fC *fU | 437 | XXXXXXX XXXXXXX XXXXX | Exon51: 14OMe-6F all-PS | DMD Exon51 |
| WV-884 | UCAAGGA AGAUGGC AUUUCU | 54 | mU*RmC*RmA*RmA*RmG*RmG*RmA *RmA*RmG*RmA*RmU*RmG*RmG*R mC*RmA*RmU*RmU*RmU*RmC*RmU | 263 | RRRRRRRR RRRRRRRR RRR | All-R; 2'-OMe oligo | Dystrophin |
| WV-885 | UCAAGGA AGAUGGC AUUUCU | 54 | mU*SmC*RmA*SmA*RmG*SmG*RmA* SmA*RmG*SmA*RmU*SmG*RmG*SmC *RmA*SmU*RmU*SmU*RmC*SmU | 264 | SRSRSRSRS RSRSRSRSRS | (SR)9S; 2'-OMe oligo | Dystrophin |
| WV-886 | UCAAGGA AGAUGGC AUUUCU | 54 | mU*RmC*RmA*RmA*SmG*SmG*SmA* SmA*SmG*SmA*SmU*SmG*SmG*SmC *SmA*SmU*SmU*RmU*RmC*RmU | 265 | RRRSSSSSS SSSSSSSRRR | R3S13R3; 2'-OMe oligo | Dystrophin |
| WV-887 | UCAAGGA AGAUGGC AUUUCU | 54 | mU*SmC*SmA*SmA*RmG*RmG*RmA* RmA*RmG*RmA*RmU*RmG*RmG*Rm C*RmA*RmU*RmU*SmU*SmC*SmU | 266 | SSSRRRRRR RRRRRRRS SS | S3R13S3; 2'-OMe oligo | Dystrophin |
| WV-888 | UCAAGGA AGAUGGC AUUUCU | 54 | mU*RmC*RmA*RmA*RmG*RmG*SmA *SmA*RmG*SmA*SmU*RmG*SmG*Sm C*RmA*RmU*RmU*RmU*RmC*RmU | 267 | RRRRRSSRS SRSSRRRRR | R5(SSR)3R5; 2'-OMe oligo | Dystrophin |
| WV-889 | UCAAGGA AGAUGGC AUUUCU | 54 | mU*SmC*SmA*SmA*SmG*SmG*RmA* RmA*SmG*RmA*RmU*SmG*RmG*Rm C*SmA*SmU*SmU*SmU*SmC*SmU | 268 | SSSSSRRSR RSRRSSSSS | S5(RRS)3S5; 2'-OMe oligo | Dystrophin |
| WV-890 | UCAAGGA AGAUGGC AUUUCU | 54 | mU*RmC*RmA*RmA*SmG*SmG*RmA* RmA*SmG*RmA*RmU*RmG*SmG*Rm C*RmA*SmU*SmU*RmU*RmC*RmU | 269 | RRRSSRRSR RRSRRSSRRR | R3S2R2SR3SR2S2R3; 2'-OMe oligo | Dystrophin |
| WV-891 | UCAAGGA AGAUGGC AUUUCU | 54 | mU*SmC*SmA*SmA*RmG*RmG*SmA* SmA*RmG*SmA*SmU*SmG*RmG*SmC *SmA*RmU*RmU*SmU*SmC*SmU | 270 | SSSRRSSRS SSRSSRRSSS | S3R2S2RS3RS2R2S3; 2'-OMe oligo | Dystrophin |

TABLE 4-continued

| Example Oligonucleotides | | | | | | | |
|---|---|---|---|---|---|---|---|
| WAVE ID | Base Sequence | SEQ ID NO: | Description | SEQ ID NO: | Stereochemistry[1] | Notes | Target/Program |
| WV-892 | UCAAGGAAGAUGGCAUUUCU | 54 | mU*SmC*RmA*RmA*RmG*RmG*RmA*RmA*RmG*RmA*RmU*RmG*RmG*RmC*RmA*RmU*RmU*RmU*RmC*SmU | 271 | SRRRRRRRRRRRRRRRRRS | SR17S; 2'-OMe chimeric oligo | Dystrophin |
| WV-893 | UCAAGGAAGAUGGCAUUUCU | 54 | mU*RmC*SmA*SmA*SmG*SmG*SmA*SmA*SmG*SmA*SmU*SmG*SmG*SmC*SmA*SmU*SmU*SmU*SmC*RmU | 272 | RSSSSSSSSSSSSSSSSSR | RS17R; 2'-OMe chimeric oligo | Dystrophin |
| WV-894 | UCAAGGAAGAUGGCAUUUCU | 54 | mU*SmC*RmA*SmA*SmG*RmG*RmA*SmA*SmG*RmA*SmU*SmG*RmG*RmC*RmA*SmU*SmU*SmU*SmC*RmU | 273 | SRSSRRSSRSSRRSSSSR | GC(R) and AU(S) 2'-OMe oligo | Dystrophin |
| WV-895 | UCAAGGAAGAUGGCAUUUCU | 54 | mU*RmC*SmA*RmA*RmG*SmG*SmA*RmA*RmG*SmA*RmU*RmG*SmG*SmC*SmA*RmU*RmU*RmU*RmC*SmU | 274 | RSRRSSRRSRRSSSRRRRS | GC(S) and AU(R) 2'-OMe oligo | Dystrophin |
| WV-896 | UCAAGGAAGAUGGCAUUUCU | 54 | mU*SmC*SmA*RmA*RmG*RmG*RmA*RmA*RmG*RmA*RmU*SmG*RmG*RmC*SmA*RmU*SmU*SmU*SmC*SmU | 275 | SSRRRRRRRSRRSRSSSS | GA(R) and CU(S) 2'-OMe oligo | Dystrophin |
| WV-897 | UCAAGGAAGAUGGCAUUUCU | 54 | mU*RmC*RmA*SmA*SmG*SmG*SmA*SmA*SmG*SmA*SmU*RmG*SmG*SmC*RmA*SmU*RmU*RmU*RmC*RmU | 276 | RRSSSSSSSRSSRSRRRR | GA(S) and CU(R) 2'-OMe oligo | Dystrophin |
| WV-1678 | GGCCAAACCUCGGCUUACCU | 66 | fG*fG*fC*fC*fA*fA*fA*fC*fC*fU*fC*fG*fG*fC*fU*fU*fA*fC*fC*fU | 414 | XXXXXXXXXXXXXXXXXXX | All 2'-F modified | Exon 23 |
| WV-1679 | GGCCAAACCUCGGCUUACCU | 66 | mG*mG*fC*fC*mA*mA*mA*fC*fC*fU*fC*mG*mG*fC*fU*fU*mA*fC*fC*fU | 415 | XXXXXXXXXXXXXXXXXXX | 2'-F pyrimidines; 2'-OMe purines | Exon 23 |
| WV-1680 | GGCCAAACCUCGGCUUACCU | 66 | fG*fG*mC*mC*fA*fA*fA*mC*mC*mU*mC*fG*fG*mC*mU*mU*fA*mC*mC*mU | 416 | XXXXXXXXXXXXXXXXXXX | 2'-F purines; 2'-OMe pyrimidines | Exon 23 |
| WV-1681 | GGCCAAACCUCGGCUUACCU | 66 | mG*fG*mC*fC*mA*fA*mA*fC*mC*fU*mC*fG*mG*fC*mU*fU*mA*fC*mC*fU | 417 | XXXXXXXXXXXXXXXXXXX | Alternate 2'-OMe/2'F | Exon 23 |
| WV-1682 | GGCCAAACCUCGGCUUACCU | 66 | mG*mG*mC*mC*mA*mA*fA*fC*fC*fU*fC*fG*fG*fC*mU*mU*mA*mC*mC*mU | 418 | XXXXXXXXXXXXXXXXXXX | 2'-OMe/2'-F/2'-OMe gapmer | Exon 23 |
| WV-1683 | GGCCAAACCUCGGCUUACCU | 66 | fG*fG*fC*fC*fA*fA*mA*mC*mC*mU*mC*mG*mG*mC*fU*fU*fA*fC*fC*fU | 419 | XXXXXXXXXXXXXXXXXXX | 2'-F/2'-OMe/2'-F gapmer | Exon 23 |

TABLE 4-continued

| Example Oligonucleotides | | | | | | | |
|---|---|---|---|---|---|---|---|
| WAVE ID | Base Sequence | SEQ ID NO: | Description | SEQ ID NO: | Stereochemistry[1] | Notes | Target/Program |
| WV-1684 | GGCCAAACCUCGGCUUACCU | 66 | fG*fG*fC*fC*mA*mA*mA*fC*fC*mU*fC*fG*fG*fC*mU*mU*mA*fC*fC*mU | 420 | XXXXXXXXXXXXXXXXXXX | 2'-F (C; G); 2'-OMe (U; A) | Exon 23 |
| WV-1685 | GGCCAAACCUCGGCUUACCU | 66 | mG*mG*mC*mC*fA*fA*fA*mC*mC*fU*mC*mG*mG*mC*fU*fU*fA*mC*mC*fU | 421 | XXXXXXXXXXXXXXXXXXX | 2'-F (U; A); 2'-OMe (C; G) | Exon 23 |
| WV-1709 | UCAAGGAAGAUGGCAUUUCU | 54 | fU*fC*fA*fA*fG*fG*fA*fA*fG*fA*fU*fG*fG*fC*fA*fU*fU*fU*fC*fU | 301 | XXXXXXXXXXXXXXXXXXX | | Exon 51 |
| WV-1710 | UCAAGGAAGAUGGCAUUUCU | 54 | fU*fC*mA*mA*mG*mG*mA*mA*mG*mA*fU*mG*mG*fC*mA*fU*fU*fU*fC*fU | 302 | XXXXXXXXXXXXXXXXXXX | | Exon 51 |
| WV-1711 | UCAAGGAAGAUGGCAUUUCU | 54 | mU*mC*fA*fA*fG*fG*fA*fA*fG*fA*mU*fG*fG*mC*fA*mU*mU*mU*mC*mU | 303 | XXXXXXXXXXXXXXXXXXX | | Exon 51 |
| WV-1712 | UCAAGGAAGAUGGCAUUUCU | 54 | mU*fC*mA*fA*mG*fG*mA*fA*mG*fA*mU*fG*mG*fC*mA*fU*mU*fU*mC*fU | 304 | XXXXXXXXXXXXXXXXXXX | | Exon 51 |
| WV-1713 | UCAAGGAAGAUGGCAUUUCU | 54 | mU*mC*mA*mA*mG*mG*fA*fA*fG*fA*fU*fG*fG*fC*mA*mU*mU*mU*mC*mU | 305 | XXXXXXXXXXXXXXXXXXX | | Exon 51 |
| WV-1714 | UCAAGGAAGAUGGCAUUUCU | 54 | fU*fC*fA*fA*fG*fG*mA*mA*mG*mA*mU*mG*mG*mC*fA*fU*fU*fU*fC*fU | 306 | XXXXXXXXXXXXXXXXXXX | | Exon 51 |
| WV-1715 | UCAAGGAAGAUGGCAUUUCU | 54 | mU*fC*mA*mA*fG*fG*mA*mA*fG*mA*mU*fG*fG*fC*mA*mU*mU*mU*fC*mU | 307 | XXXXXXXXXXXXXXXXXXX | | Exon 51 |
| WV-1716 | UCAAGGAAGAUGGCAUUUCU | 54 | fU*mC*fA*fA*mG*mG*fA*fA*mG*fA*fU*mG*mG*mC*fA*fU*fU*fU*mC*fU | 308 | XXXXXXXXXXXXXXXXXXX | | Exon 51 |
| WV-1093 | GGCCAAACCTCGGCTTACCT | 65 | G*G*C*C*A*A*A*C*C*T*C*G*G*C*T*T*A*C*C*T | 370 | XXXXXXXXXXXXXXXXXXX | Stereorandom DNA version of Exon23 full PS: Analog of WV943 | Exon23 |
| WV-1094 | GGCCAAACCUCGGCUUACCU | 66 | mGmGmCmCmAmAmAmCmCmUmCmGmGmCmUmUmAmCmCmU | 371 | OOOOOOOOOOOOOOOOOOO | Full PO version of WV943 | Exon23 |

TABLE 4-continued

| Example Oligonucleotides | | | | | | | |
|---|---|---|---|---|---|---|---|
| WAVE ID | Base Sequence | SEQ ID NO: | Description | SEQ ID NO: | Stereochemistry[1] | Notes | Target/Program |
| WV-1095 | GGCCAAACCTCGGCTTACCT | 65 | G*RG*RC*RC*RA*RA*RA*RC*RC*RT*RC*RG*RG*RC*RT*RT*RA*RC*RC*RT | 372 | RRRRRRRRRRRRRRRRRRR | Full Rp DNA version of Exon23: Analog of WV943 | Exon23 |
| WV-1096 | GGCCAAACCTCGGCTTACCT | 65 | G*SG*SC*SC*SA*SA*SA*SC*SC*ST*SC*SG*SG*SC*ST*ST*SA*SC*SC*ST | 373 | SSSSSSSSSSSSSSSSSSS | Full Sp DNA version of Exon23: Analog of WV943 | Exon23 |
| WV-1097 | GGCCAAACCUCGGCTTACCT | 67 | G*SG*SC*SC*SA*SmAmAmCmCmUmCmGmGmCT*ST*SA*SC*SC*ST | 374 | SSSSSOOOOOOOOOSSSSS | Stereopure DNA/2'OMe chimeric version of Exon23: Analog of 943 | Exon23 |
| WV-1098 | GGCCAAACCTCGGCTTACCU | 68 | mGmGmCmCA*SA*SA*SmCC*ST*SC*SG*SmGC*ST*ST*SmAmCmCmU | 375 | OOOOSSSOSSSSOSSSOOO | Stereopure DNA/2'OMe chimeric version of Exon23: Analog of 943 | Exon23 |
| WV-1099 | GGCCAAACCUCGGCTUACCU | 69 | G*SmGC*SmCA*SmAA*SmCC*SmUC*SmGG*SmCT*SmUA*SmCC*SmU | 376 | SOSOSOSOSOSOSOSOSOS | Stereopure DNA/2'OMe chimeric version of Exon23: Analog of 943 | Exon23 |
| WV-1100 | GGCCAAACCTCGGCUTACCU | 70 | mGG*SmCC*SmAA*SmAC*SmCT*SmCG*SmGC*SmUT*SmAC*SmCmU | 377 | OSOSOSOSOSOSOSOSOSO | Stereopure DNA/2'OMe chimeric version of Exon23: Analog of 943 | Exon23 |
| WV-1101 | GGCCAAACCTCGGCTUACCU | 71 | G*SG*SmCmCA*SA*SmAmCC*ST*SC*SmGmGC*ST*SmUmAC*SC*SmU | 378 | SSOOSSOOSSSOOSSOOSS | Stereopure DNA/2'OMe chimeric version of Exon23: Analog of 943 | Exon23 |
| WV-1102 | GGCCAAACCUCGGCUUACCU | 66 | G*SG*SC*SmCmAmAA*SC*SmCmUmCG*SG*SmCmUmUA*SC*SC*SmU | 379 | SSSOOOSSOOOSSOOOSSS | Stereopure DNA/2'OMe chimeric version of Exon23: Analog of 943 | Exon23 |
| WV-1103 | GGCCAAACCTCGGCUTACCU | 70 | G*SG*SC*SC*SmAmAmAmCC*ST*SC*SmGmGmCmUT*SA*SC*SC*SmU | 380 | SSSSOOOOSSSOOOOSSSS | Stereopure DNA/2'OMe chimeric version of Exon23: Analog of 943 | Exon23 |
| WV-1104 | GGCCAAACCTCGGCTUACCU | 71 | G*SG*SC*SmCA*SA*SA*SmCC*ST*SC*SmGG*SC*ST*SmUA*SC*SC*SmU | 381 | SSSOSSSOSSSOSSSOSSS | Stereopure DNA/2'OMe chimeric version of Exon23: Analog of 943 | Exon23 |
| WV-1105 | GGCCAAACCUCGGCTTACCU | 72 | mGmGmCmCA*SA*SA*SC*SC*SmUmCmGmGmCT*ST*SA*SC*SC*SmU | 382 | OOOOSSSSSOOOOOSSSSS | Stereopure DNA/2'OMe chimeric version of Exon23: Analog of 943 | Exon23 |
| WV-1121 | GGCCAAACCUCGGCTTACCT | 67 | G*G*C*C*A*mAmAmCmCmUmCmGmGmCT*T*A*C*C*T | 384 | XXXXXOOOOOOOOOXXXXX | Stereorandom DNA/2'OMe chimeric version of Exon23: Analog of WV1097 | Exon23 |

TABLE 4-continued

| Example Oligonucleotides | | | | | | | |
|---|---|---|---|---|---|---|---|
| WAVE ID | Base Sequence | SEQ ID NO: | Description | SEQ ID NO: | Stereochemistry[1] | Notes | Target/Program |
| WV-1122 | GGCCAAACCTCGGCTTACCU | 68 | mGmGmCmCA*A*A*mCC*T*C*G*mGC*T*T*mAmCmCmU | 385 | OOOOXXXOXXXXOXXXOOO | Stereorandom DNA/2'OMe chimeric version of Exon23: Analog of WV1098 | Exon23 |
| WV-1123 | GGCCAAACCUCGGCTUACCU | 69 | G*mGC*mCA*mAA*mCC*mUC*mGG*mCT*mUA*mCC*mU | 386 | XOXOXOXOXOXOXOXOXOX | Stereorandom DNA/2'OMe chimeric version of Exon23: Analog of WV1099 | Exon23 |
| WV-1124 | GGCCAAACCTCGGCUTACCU | 70 | mGG*mCC*mAA*mAC*mCT*mCG*mGC*mUT*mAC*mCmU | 387 | OXOXOXOXOXOXOXOXOXO | Stereorandom DNA/2'OMe chimeric version of Exon23: Analog of WV1100 | Exon23 |
| WV-1125 | GGCCAAACCTCGGCTUACCU | 71 | G*G*mCmCA*A*mAmCmCT*C*mGmGC*T*mUmAC*C*mU | 388 | XXOOXXOOOXXOOXXOOXX | Stereorandom DNA/2'OMe chimeric version of Exon23: Analog of WV1101 | Exon23 |
| WV-1126 | GGCCAAACCUCGGCUUACCU | 66 | G*G*C*mCmAmAA*C*mCmUmCG*G*mCmUmUA*C*C*mU | 389 | XXXOOOXXOOOXXOOOXXX | Stereorandom DNA/2'OMe chimeric version of Exon23: Analog of WV1102 | Exon23 |
| WV-1127 | GGCCAAACCTCGGCUTACCU | 70 | G*G*C*C*mAmAmAmCC*T*C*mGmGmCmUT*A*C*C*mU | 390 | XXXXOOOOXXXOOOOXXXX | Stereorandom DNA/2'OMe chimeric version of Exon23: Analog of WV1103 | Exon23 |
| WV-1128 | GGCCAAACCTCGGCTUACCU | 71 | G*G*C*mCA*A*A*mCC*T*C*mGG*C*T*mUA*C*C*mU | 391 | XXXOXXXOXXXOXXXOXXX | Stereorandom DNA/2'OMe chimeric version of Exon23: Analog of WV1104 | Exon23 |
| WV-1129 | GGCCAAACCUCGGCTTACCU | 72 | mGmGmCmCA*A*A*C*C*mUmCmGmGmCT*T*A*C*C*mU | 392 | OOOOXXXXXOOOOOXXXXX | Stereorandom DNA/2'OMe chimeric version of Exon23: Analog of WV1105 | Exon23 |
| WV-1130 | GGCCAAACCUCGGCUTACCU | 73 | G*G*mCmCmAmAmAmCmCmUC*mGmGC*mUT*A*C*C*mU | 393 | XXOOOOOOOOXOOXOXXXX | Stereorandom DNA/2'OMe chimeric version of Exon23: Analog of WV1106 | Exon23 |

TABLE 4-continued

| Example Oligonucleotides | | | | | | | |
|---|---|---|---|---|---|---|---|
| WAVE ID | Base Sequence | SEQ ID NO: | Description | SEQ ID NO: | Stereochemistry[1] | Notes | Target/Program |
| WV-1141 | GGCCAAACCUCGGCUUACCU | 66 | mG*mG*mC*mC*mA*mAmAmCmCmUmCmGmGmCmU*mU*mA*mC*mC*mU | 394 | XXXXXOOOOOOOOOXXXXX | Stereorandom 2'OMe PO/PS chimeric version of exon23: Analog of WV1097 | Exon23 |
| WV-1142 | GGCCAAACCUCGGCUUACCU | 66 | mGmGmCmCmA*mA*mA*mCmC*mU*mC*mG*mGmC*mU*mU*mAmCmCmU | 395 | OOOOXXXOXXXXOXXXOOO | Stereorandom 2'OMe PO/PS chimeric version of exon23: Analog of WV1098 | Exon23 |
| WV-1143 | GGCCAAACCUCGGCUUACCU | 66 | mG*mGmC*mCmA*mAmA*mCmC*mUmC*mGmG*mCmU*mUmA*mCmC*mU | 396 | XOXOXOXOXOXOXOXOXOX | Stereorandom 2'OMe PO/PS chimeric version of exon23: Analog of WV1099 | Exon23 |
| WV-1144 | GGCCAAACCUCGGCUUACCU | 66 | mGmG*mCmC*mAmA*mAmC*mCmU*mCmG*mGmC*mUmU*mAmC*mCmU | 397 | OXOXOXOXOXOXOXOXOXO | Stereorandom 2'OMe PO/PS chimeric version of exon23: Analog of WV1100 | Exon23 |
| WV-1145 | GGCCAAACCUCGGCUUACCU | 66 | mG*mG*mCmCmA*mA*mAmCmCmU*mC*mGmGmC*mU*mUmAmC*mC*mU | 398 | XXOOXXOOOXXOOXXOOXX | Stereorandom 2'OMe PO/PS chimeric version of exon23: Analog of WV1101 | Exon23 |
| WV-1146 | GGCCAAACCUCGGCUUACCU | 66 | mG*mG*mC*mCmAmAmA*mC*mCmUmCmG*mG*mCmUmUmA*mC*mC*mU | 399 | XXXOOOXXOOOXXOOOXXX | Stereorandom 2'OMe PO/PS chimeric version of exon23: Analog of WV1102 | Exon23 |
| WV-1147 | GGCCAAACCUCGGCUUACCU | 66 | mG*mG*mC*mC*mAmAmAmCmC*mU*mC*mGmGmCmUmU*mA*mC*mC*mU | 400 | XXXXOOOOXXXOOOOXXXX | Stereorandom 2'OMe PO/PS chimeric version of exon23: Analog of WV1103 | Exon23 |
| WV-1148 | GGCCAAACCUCGGCUUACCU | 66 | mG*mG*mC*mCmA*mA*mA*mCmC*mU*mC*mGmG*mC*mU*mUmA*mC*mC*mU | 401 | XXXOXXXOXXXOXXXOXXX | Stereorandom 2'OMe PO/PS chimeric version of exon23: Analog of WV1104 | Exon23 |
| WV-1149 | GGCCAAACCUCGGCUUACCU | 66 | mGmGmCmCmA*mA*mA*mC*mC*mUmCmGmGmCmU*mU*mA*mC*mC*mU | 402 | OOOOXXXXXOOOOOXXXXX | Stereorandom 2'OMe PO/PS chimeric version of exon23: Analog of WV1105 | Exon23 |

TABLE 4-continued

| Example Oligonucleotides | | | | | | | |
|---|---|---|---|---|---|---|---|
| WAVE ID | Base Sequence | SEQ ID NO: | Description | SEQ ID NO: | Stereochemistry[1] | Notes | Target/Program |
| WV-1150 | GGCCAAACCUCGGCUUACCU | 66 | mG*mG*mCmCmAmAmAmCmCmUmC*mGmGmC*mUmU*mA*mC*mC*mU | 403 | XXOOOOOOOOXOOXOXXXX | Stereorandom 2'OMe PO/PS chimeric version of exon23: Analog of WV1106 | Exon23 |
| WV-2733 | GGCCAAACCUCGGCUUACCU | 66 | L001*mG*mG*mC*mC*mA*mA*mA*mC*mC*mU*mC*mG*mG*mC*mU*mU*mA*mC*mC*mU | 688 | XXXXXXXXXXXXXXXXXXXX | All-OMe full-PS | Exon23 |
| WV-2734 | GGCCAAACCUCGGCUUACCUGAAAU | 257 | L001*mG*mG*mC*mC*mA*mA*mA*mC*mC*mU*mC*mG*mG*mC*mU*mU*mA*mC*mC*mU*mG*mA*mA*mA*mU | 689 | XXXXXXXXXXXXXXXXXXXXXXXXX | All-OMe full-PS | Exon23 |
| WV-1106 | GGCCAAACCUCGGCUTACCU | 73 | G*SG*SmCmCmAmAmAmCmCmUC*SmGmGC*SmUT*SA*SC*SC*SmU | 383 | SSOOOOOOOSOOSOSSSS | Stereopure DNA/2'OMe chimeric version of Exon23: Analog of 943 | Exon51 |
| WV-1107 | TCAAGGAAGATGGCATTTCT | 55 | T*C*A*A*G*G*A*A*G*A*T*G*G*C*A*T*T*T*C*T | 277 | XXXXXXXXXXXXXXXXXXX | Stereorandom DNA version of Exon51 full PS: Analog of WV942 | Exon51 |
| WV-1108 | UCAAGGAAGAUGGCAUUUCU | 54 | mUmCmAmAmGmGmAmAmGmAmUmGmGmCmAmUmUmUmCmU | 278 | OOOOOOOOOOOOOOOOOOO | Full PO version of WV942 | Exon51 |
| WV-1109 | TCAAGGAAGATGGCATTTCT | 55 | T*RC*RA*RA*RG*RG*RA*RA*RG*RA*RT*RG*RG*RC*RA*RT*RT*RT*RC*RT | 279 | RRRRRRRRRRRRRRRRRRR | Full Rp DNA version of Exon51: Analog of WV942 | Exon51 |
| WV-1110 | TCAAGGAAGATGGCATTTCT | 55 | T*SC*SA*SA*SG*SG*SA*SA*SG*SA*ST*SG*SG*SC*SA*ST*ST*ST*SC*ST | 280 | SSSSSSSSSSSSSSSSSSS | Full Rp DNA version of Exon51: Analog of WV942 | Exon51 |
| WV-1111 | TCAAGGAAGAUGGCATTTCT | 56 | T*SC*SA*SA*SG*SmGmAmAmGmAmUmGmGmCA*ST*ST*ST*SC*ST | 281 | SSSSSOOOOOOOOOSSSSS | Stereopure DNA/2'OMe chimeric version of Exon51: Analog of 942 | Exon51 |
| WV-1112 | UCAAGGAAGATGGCATUUCU | 57 | mUmCmAmAG*SG*SA*SmAG*SA*ST*SG*SmGC*SA*ST*SmUmUmCmU | 282 | OOOOSSSOSSSSOSSSOOO | Stereopure DNA/2'OMe chimeric version of Exon51: Analog of 942 | Exon51 |
| WV-1113 | TCAAGGAAGATGGCAUTUCU | 58 | T*SmCA*SmAG*SmGA*SmAG*SmAT*SmGG*SmCA*SmUT*SmUC*SmU | 283 | SOSOSOSOSOSOSOSOSOS | Stereopure DNA/2'OMe chimeric version of Exon51: Analog of 942 | Exon51 |

TABLE 4-continued

| Example Oligonucleotides | | | | | | | |
|---|---|---|---|---|---|---|---|
| WAVE ID | Base Sequence | SEQ ID NO: | Description | SEQ ID NO: | Stereochemistry[1] | Notes | Target/Program |
| WV-1114 | UCAAGGAAGAUGGCATUTCU | 59 | mUC*SmAA*SmGG*SmAA*SmGA*SmUG*SmGC*SmAT*SmUT*SmCmU | 284 | OSOSOSOSOSOSOSOSOSO | Stereopure DNA/2'OMe chimeric version of Exon51: Analog of 942 | Exon51 |
| WV-1115 | TCAAGGAAGATGGCAUUTCU | 60 | T*SC*SmAmAG*SG*SmAmAG*SA*ST*SmGmGC*SA*SmUmUT*SC*SmU | 285 | SSOOSSOOSSSOOSSOOSS | Stereopure DNA/2'OMe chimeric version of Exon51: Analog of 942 | Exon51 |
| WV-1116 | TCAAGGAAGAUGGCAUTTCU | 61 | T*SC*SA*SmAmGmGA*SA*SmGmAmUG*SG*SmCmAmUT*ST*SC*SmU | 286 | SSSOOOSSOOOSSOOOSSS | Stereopure DNA/2'OMe chimeric version of Exon51: Analog of 942 | Exon51 |
| WV-1117 | TCAAGGAAGATGGCATTTCU | 62 | T*SC*SA*SA*SmGmGmAmAG*SA*ST*SmGmGmCmAT*ST*ST*SC*SmU | 287 | SSSSOOOOSSSOOOOSSSS | Stereopure DNA/2'OMe chimeric version of Exon51: Analog of 942 | Exon51 |
| WV-1118 | TCAAGGAAGATGGCAUTTCU | 63 | T*SC*SA*SmAG*SG*SA*SmAG*SA*ST*SmGG*SC*SA*SmUT*ST*SC*SmU | 288 | SSSOSSSOSSSOSSSOSSS | Stereopure DNA/2'OMe chimeric version of Exon51: Analog of 942 | Exon51 |
| WV-1119 | UCAAGGAAGAUGGCATTTCU | 64 | mUmCmAmAG*SG*SA*SA*SG*SmAmUmGmGmCA*ST*ST*ST*SC*SmU | 289 | OOOOSSSSSOOOOOSSSSS | Stereopure DNA/2'OMe chimeric version of Exon51: Analog of 942 | Exon51 |
| WV-1120 | TCAAGGAAGATGGCATTTCU | 62 | T*SC*SmAmAmGmGmAmAmGmAT*SmGmGC*SmAT*ST*ST*SC*SmU | 290 | SSOOOOOOOSOOSOSSSS | Stereopure DNA/2'OMe chimeric version of Exon51: Analog of 942 | Exon51 |
| WV-1131 | TCAAGGAAGAUGGCATTTCT | 56 | T*C*A*A*G*mGmAmAmGmAmUmGmGmCA*T*T*T*C*T | 291 | XXXXXOOOOOOOOXXXXX | Stereorandom DNA/2'OMe chimeric version of Exon51: Analog of WV1111 | Exon51 |
| WV-1132 | UCAAGGAAGATGGCATUUCU | 57 | mUmCmAmAG*G*A*mAG*A*T*G*mGC*A*T*mUmUmCmU | 292 | OOOOXXXOXXXXOXXXOOO | Stereorandom DNA/2'OMe chimeric version of Exon51: Analog of WV1112 | Exon51 |
| WV-1133 | TCAAGGAAGATGGCAUTUCU | 58 | T*mCA*mAG*mGA*mAG*mAT*mGG*mCA*mUT*mUC*mU | 293 | XOXOXOXOXOXOXOXOXOX | Stereorandom DNA/2'OMe chimeric version of Exon51: Analog of WV1113 | Exon51 |
| WV-1134 | UCAAGGAAGAUGGCATUTCU | 59 | mUC*mAA*mGG*mAA*mGA*mUG*mGC*mAT*mUT*mCmU | 294 | OXOXOXOXOXOXOXOXOXO | Stereorandom DNA/2'OMe chimeric version of Exon51: Analog of WV1114 | Exon51 |

TABLE 4-continued

| Example Oligonucleotides | | | | | | | |
|---|---|---|---|---|---|---|---|
| WAVE ID | Base Sequence | SEQ ID NO: | Description | SEQ ID NO: | Stereochemistry[1] | Notes | Target/Program |
| WV-1135 | TCAAGGAAGATGGCAUUTCU | 60 | T*C*mAmAG*G*mAmAG*A*T*mGmGC*A*mUmUT*C*mU | 295 | XXOOXXOOXXXOOXXOOXX | Stereorandom DNA/2'OMe chimeric version of Exon51: Analog of WV1115 | Exon51 |
| WV-1136 | TCAAGGAAGAUGGCAUTTCU | 61 | T*C*A*mAmGmGA*A*mGmAmUG*G*mCmAmUT*T*C*mU | 296 | XXXOOOXXOOOXXOOOXXX | Stereorandom DNA/2'OMe chimeric version of Exon51: Analog of WV1116 | Exon51 |
| WV-1137 | TCAAGGAAGATGGCATTTCU | 62 | T*C*A*A*mGmGmAmAG*A*T*mGmGmCmAT*T*T*C*mU | 297 | XXXXOOOOXXXOOOOXXXX | Stereorandom DNA/2'OMe chimeric version of Exon51: Analog of WV1117 | Exon51 |
| WV-1138 | TCAAGGAAGATGGCAUTTCU | 63 | T*C*A*mAG*G*A*mAG*A*T*mGG*C*A*mUT*T*C*mU | 298 | XXXOXXXOXXXOXXXOXXX | Stereorandom DNA/2'OMe chimeric version of Exon51: Analog of WV1118 | Exon51 |
| WV-1139 | UCAAGGAAGAUGGCATTTCU | 64 | mUmCmAmAG*G*A*A*G*mAmUmGmGmCA*T*T*T*C*mU | 299 | OOOOXXXXXOOOOOXXXXX | Stereorandom DNA/2'OMe chimeric version of Exon51: Analog of WV1119 | Exon51 |
| WV-1140 | TCAAGGAAGATGGCATTTCU | 62 | T*C*mAmAmGmGmAmAmGmAT*mGmGC*mAT*T*T*C*mU | 300 | XXOOOOOOOOXOOXOXXXX | Stereorandom DNA/2'OMe chimeric version of Exon51: Analog of WV1120 | Exon51 |
| WV-1151 | UCAAGGAAGAUGGCAUUUCU | 54 | mU*mC*mA*mA*mG*mGmAmAmGmAmUmGmGmCmA*mU*mU*mU*mC*mU | 404 | XXXXXOOOOOOOOOXXXXX | Stereorandom 2'OMe PO/PS chimeric version of exon51: Analog of WV1111 | Exon51 |
| WV-1152 | UCAAGGAAGAUGGCAUUUCU | 54 | mUmCmAmAmG*mG*mA*mAmG*mA*mU*mG*mGmC*mA*mU*mUmUmCmU | 405 | OOOOXXXOXXXXOXXXOOO | Stereorandom 2'OMe PO/PS chimeric version of exon51: Analog of WV1112 | Exon51 |
| WV-1153 | UCAAGGAAGAUGGCAUUUCU | 54 | mU*mCmA*mAmG*mGmA*mAmG*mAmU*mGmG*mCmA*mUmU*mUmC*mU | 406 | XOXOXOXOXOXOXOXOXOX | Stereorandom 2'OMe PO/PS chimeric version of exon51: Analog of WV1113 | Exon51 |
| WV-1154 | UCAAGGAAGAUGGCAUUUCU | 54 | mUmC*mAmA*mGmG*mAmA*mGmA*mUmG*mGmC*mAmU*mUmU*mCmU | 407 | OXOXOXOXOXOXOXOOXOXO | Stereorandom 2'OMe PO/PS chimeric version of exon51: Analog of WV1114 | Exon51 |

TABLE 4-continued

| Example Oligonucleotides | | | | | | | |
|---|---|---|---|---|---|---|---|
| WAVE ID | Base Sequence | SEQ ID NO: | Description | SEQ ID NO: | Stereochemistry[1] | Notes | Target/Program |
| WV-1155 | UCAAGGA AGAUGGC AUUUCU | 54 | mU*mC*mAmAmG*mG*mAmAmG*mA *mU*mGmGmC*mA*mUmUmU*mC*mU | 408 | XXOOXXO OXXXOOX XOOXX | Stereorandom 2'OMe PO/PS chimeric version of exon51: Analog of WV1115 | Exon51 |
| WV-1156 | UCAAGGA AGAUGGC AUUUCU | 54 | mU*mC*mA*mAmGmGmA*mA*mGmA mUmG*mG*mCmAmUmU*mU*mC*mU | 409 | XXXOOOX XOOOXXO OOXXX | Stereorandom 2'OMe PO/PS chimeric version of exon51: Analog of WV1116 | Exon51 |
| WV-1157 | UCAAGGA AGAUGGC AUUUCU | 54 | mU*mC*mA*mA*mGmGmAmAmG*mA *mU*mGmGmCmAmU*mU*mU*mC*mU | 410 | XXXXOOO OXXXOOO OXXXX | Stereorandom 2'OMe PO/PS chimeric version of exon51: Analog of WV1117 | Exon51 |
| WV-1158 | UCAAGGA AGAUGGC AUUUCU | 54 | mU*mC*mA*mAmG*mG*mA*mAmG*m A*mU*mGmG*mC*mA*mUmU*mU*mC *mU | 411 | XXXOXXX OXXXOXX XOXXX | Stereorandom 2'OMe PO/PS chimeric version of exon51: Analog of WV1118 | Exon51 |
| WV-1159 | UCAAGGA AGAUGGC AUUUCU | 54 | mUmCmAmAmG*mG*mA*mA*mG*mA mUmGmGmCmA*mU*mU*mU*mC*mU | 412 | OOOOXXX XXOOOOO XXXXX | Stereorandom 2'OMe PO/PS chimeric version of exon51: Analog of WV1119 | Exon51 |
| WV-1160 | UCAAGGA AGAUGGC AUUUCU | 54 | mU*mC*mAmAmGmGmAmAmGmAmU *mGmGmC*mAmU*mU*mU*mC*mU | 413 | XXOOOOO OOOXOOX OXXXX | Stereorandom 2'OMe PO/PS chimeric version of exon51: Analog of WV1120 | Exon51 |
| WV-1687 | AGAAAUG CCAUCUU CCUUGA | 74 | rArGrArArArUrGrCrCrArUrCrUrUrCrCrU rUrGrA | 422 | OOOOOOO OOOOOOO OOOOO | RNA | Exon51 |
| WV-2363 | UCAAGGA AGAUGGC AUUUCU | 54 | mU*SmC*SmA*RmA*RmG*RmG*RmA* RmA*RmG*RmA*RmU*RmG*RmG*Rm C*RmA*RmU*RmU*RmU*SmC*SmU | 619 | SSRRRRRR RRRRRRRR RSS | Exon51: 2S-15R-2S | Exon51 |
| WV-2364 | UCAAGGA AGAUGGC AUUUCU | 54 | mU*SmC*SmA*SmA*SmG*RmG*RmA* RmA*RmG*RmA*RmU*RmG*RmG*Rm C*RmA*RmU*SmU*SmU*SmC*SmU | 620 | SSSSRRRRR RRRRRRSSSS | Exon51: 4S-11R-4S | Exon51 |
| WV-2365 | UCAAGGA AGAUGGC AUUUCU | 54 | mU*SmC*SmA*SmA*SmG*SmG*RmA* RmA*RmG*RmA*RmU*RmG*RmG*Rm C*RmA*SmU*SmU*SmU*SmC*SmU | 621 | SSSSSRRRR RRRRRSSSSS | Exon51: 5S-9R-5S | Exon51 |

TABLE 4-continued

| Example Oligonucleotides | | | | | | | |
|---|---|---|---|---|---|---|---|
| WAVE ID | Base Sequence | SEQ ID NO: | Description | SEQ ID NO: | Stereochemistry[1] | Notes | Target/Program |
| WV-2366 | UCAAGGAAGAUGGCAUUUCU | 54 | mU*SmCmAmAmGmGmAmAmGmAmUmGmGmCmAmUmUmUmC*SmU | 622 | SOOOOOOOOOOOOOOOOOS | Exon51: 1S-17PO-1S | Exon51 |
| WV-2367 | UCAAGGAAGAUGGCAUUUCU | 54 | mU*SmC*SmAmAmGmGmAmAmGmAmUmGmGmCmAmUmUmU*SmC*SmU | 623 | SSOOOOOOOOOOOOOOOSS | Exon51: 2S-15PO-2S | Exon51 |
| WV-2368 | UCAAGGAAGAUGGCAUUUCU | 54 | mU*SmC*SmA*SmAmGmGmAmAmGmAmUmGmGmCmAmUmU*SmU*SmC*SmU | 624 | SSSOOOOOOOOOOOOOSSS | Exon51: 3S-13PO-3S | Exon51 |
| WV-2369 | UCAAGGAAGAUGGCAUUUCU | 54 | mU*SmC*SmA*SmA*SmGmGmAmAmGmAmUmGmGmCmAmU*SmU*SmU*SmC*SmU | 625 | SSSSOOOOOOOOOOOSSSS | Exon51: 4S-11PO-4S | Exon51 |
| WV-2370 | UCAAGGAAGAUGGCAUUUCU | 54 | mU*SmC*SmA*SmA*SmG*SmGmAmAmGmAmUmGmGmCmA*SmU*SmU*SmU*SmC*SmU | 626 | SSSSSOOOOOOOOOSSSSS | Exon51: 5S-9PO-5S | Exon51 |
| WV-2381 | UCAAGGAAGAUGGCAUUUCU | 54 | mU*mCmAmAmGmGmAmAmGmAmUmGmGmCmAmUmUmUmC*mU | 627 | XOOOOOOOOOOOOOOOOOX | Exon51: 1PS-17PO-1PS stereorandom | Exon51 |
| WV-2382 | UCAAGGAAGAUGGCAUUUCU | 54 | mU*mC*mAmAmGmGmAmAmGmAmUmGmGmCmAmUmUmU*mC*mU | 628 | XXOOOOOOOOOOOOOOOXX | Exon51: 2PS-15PO-2PS stereorandom | Exon51 |
| WV-2383 | UCAAGGAAGAUGGCAUUUCU | 54 | mU*mC*mA*mAmGmGmAmAmGmAmUmGmGmCmAmUmU*mU*mC*mU | 629 | XXXOOOOOOOOOOOOOXXX | Exon51: 3PS-13PO-3PS stereorandom | Exon51 |
| WV-2384 | UCAAGGAAGAUGGCAUUUCU | 54 | mU*mC*mA*mA*mGmGmAmAmGmAmUmGmGmCmAmU*mU*mU*mC*mU | 630 | XXXXOOOOOOOOOOOXXXX | Exon51: 4PS-11PO-4PS stereorandom | Exon51 |
| WV-2385 | UCAAGGAAGAUGGCAUUUCU | 54 | mU*mC*mA*mA*mG*mGmAmAmGmAmUmGmGmCmA*mU*mU*mU*mC*mU | 631 | XXXXXOOOOOOOOOXXXXX | Exon51: 5PS-9PO-5PS stereorandom | Exon51 |
| WV-2432 | UCAAGGAAGAUGGCAUUUCU | 54 | fU*fC*fA*fA*fG*fG*mAmAmGmAmUmGmGmC*fA*fU*fU*fU*fC*fU | 632 | XXXXXXOOOOOOOXXXXXX | 6F-8OMe-6F 6PS-7PO-6PS | Exon51 |
| WV-2433 | UCAAGGAAGAUGGCAUUUCU | 54 | fU*fC*fA*fA*fG*mGmAmAmGmAmUmGmGmCmA*fU*fU*fU*fC*fU | 633 | XXXXXOOOOOOOOOXXXXX | 5F-10OMe-5F 5PS-9PO-5PS | Exon51 |

TABLE 4-continued

Example Oligonucleotides

| WAVE ID | Base Sequence | SEQ ID NO: | Description | SEQ ID NO: | Stereochemistry[1] | Notes | Target/Program |
|---|---|---|---|---|---|---|---|
| WV-2434 | UCAAGGAAGAUGGCAUUUCU | 54 | fU*fC*fA*fA*mGmGmAmAmGmAmUmGmGmCmAmU*fU*fU*fC*fU | 634 | XXXXOOOOOOOOOOOXXXX | 4F-12OMe-4F 4PS-11PO-4PS | Exon51 |
| WV-2435 | UCAAGGAAGAUGGCAUUUCU | 54 | fU*fC*fA*mAmGmGmAmAmGmAmUmGmGmCmAmUmU*fU*fC*fU | 635 | XXXOOOOOOOOOOOOOXXX | 3F-14OMe-3F 3PS-13PO-3PS | Exon51 |
| WV-2436 | UCAAGGAAGAUGGCAUUUCU | 54 | fU*fC*mAmAmGmGmAmAmGmAmUmGmGmCmAmUmUmU*fC*fU | 636 | XXOOOOOOOOOOOOOOOXX | 2F-16OMe-2F 2PS-15PO-2PS | Exon51 |
| WV-2437 | UCAAGGAAGAUGGCAUUUCU | 54 | fU*mCmAmAmGmGmAmAmGmAmUmGmGmCmAmUmUmUmC*fU | 637 | XOOOOOOOOOOOOOOOOOX | 1F-18OMe-1F 1PS-17PO-1PS | Exon51 |
| WV-2438 | UCAAGGAAGAUGGCAUUUCU | 54 | fU*SfC*SfA*SfA*SfG*SfG*SmAmAmGmAmUmGmGmC*SfA*SfU*SfU*SfU*SfC*SfU | 638 | SSSSSSOOOOOOOSSSSSS | 6F-8OMe-6F 6Sp-7PO-6Sp | Exon51 |
| WV-2439 | UCAAGGAAGAUGGCAUUUCU | 54 | fU*SfC*SfA*SfA*SfG*SmGmAmAmGmAmUmGmGmCmA*SfU*SfU*SfU*SfC*SfU | 639 | SSSSSOOOOOOOOOSSSSS | 5F-10OMe-5F 5Sp-9PO-5Sp | Exon51 |
| WV-2440 | UCAAGGAAGAUGGCAUUUCU | 54 | fU*SfC*SfA*SfA*SmGmGmAmAmGmAmUmGmGmCmAmU*SfU*SfU*SfC*SfU | 640 | SSSSOOOOOOOOOOOSSSS | 4F-12OMe-4F 4Sp-11PO-4Sp | Exon51 |
| WV-2441 | UCAAGGAAGAUGGCAUUUCU | 54 | fU*SfC*SfA*SmAmGmGmAmAmGmAmUmGmGmCmAmUmU*SfU*SfC*SfU | 641 | SSSOOOOOOOOOOOOOSSS | 3F-14OMe-3F 3Sp-13PO-3 Sp | Exon51 |
| WV-2442 | UCAAGGAAGAUGGCAUUUCU | 54 | fU*SfC*SmAmAmGmGmAmAmGmAmUmGmGmCmAmUmUmU*SfC*SfU | 642 | SSOOOOOOOOOOOOOOOSS | 2F-16OMe-2F 2Sp-15PO-2Sp | Exon51 |
| WV-2443 | UCAAGGAAGAUGGCAUUUCU | 54 | fU*SmCmAmAmGmGmAmAmGmAmUmGmGmCmAmUmUmUmC*SfU | 643 | SOOOOOOOOOOOOOOOOOS | 1F-18OMe-1F 1Sp-17PO-1Sp | Exon51 |
| WV-2444 | UCAAGGAAGAUGGCAUUUCU | 54 | fU*SfC*SfA*SfA*SfG*SfG*SmA*RmA*RmG*RmA*RmU*RmG*RmG*RmC*SfA*SfU*SfU*SfU*SfC*SfU | 644 | SSSSSSRRRRRRRSSSSSS | 6F-8OMe-6F 6Sp-7Rp-6Sp | Exon51 |
| WV-2445 | UCAAGGAAGAUGGCAUUUCU | 54 | fU*SfC*SfA*SfA*SfG*SmG*RmA*RmA*RmG*RmA*RmU*RmG*RmG*RmC*RmA*SfU*SfU*SfU*SfC*SfU | 645 | SSSSSRRRRRRRRRSSSSS | 5F-10OMe-5F 5Sp-9Rp-5Sp | Exon51 |

TABLE 4-continued

| Example Oligonucleotides | | | | | | | |
|---|---|---|---|---|---|---|---|
| WAVE ID | Base Sequence | SEQ ID NO: | Description | SEQ ID NO: | Stereochemistry[1] | Notes | Target/Program |
| WV-2446 | UCAAGGA AGAUGGC AUUUCU | 54 | fU*SfC*SfA*SfA*SmG*RmG*RmA*Rm A*RmG*RmA*RmU*RmG*RmG*RmC* RmA*RmU*SfU*SfU*SfC*SfU | 646 | SSSSRRRRR RRRRRRSSSS | 4F-12OMe-4F 4 Sp-11Rp-4Sp | Exon51 |
| WV-2447 | UCAAGGA AGAUGGC AUUUCU | 54 | fU*SfC*SfA*SmA*RmG*RmG*RmA*Rm A*RmG*RmA*RmU*RmG*RmG*RmC* RmA*RmU*RmU*SfU*SfC*SfU | 647 | SSSRRRRRR RRRRRRRS SS | 3F-14OMe-3F 3Sp-13Rp-3Sp | Exon51 |
| WV-2448 | UCAAGGA AGAUGGC AUUUCU | 54 | fU*SfC*SmA*RmA*RmG*RmG*RmA*R mA*RmG*RmA*RmU*RmG*RmG*RmC *RmA*RmU*RmU*RmU*SfC*SfU | 648 | SSRRRRRR RRRRRRRR RSS | 2F-16OMe-2F 2Sp-15Rp-2Sp | Exon51 |
| WV-2449 | UCAAGGA AGAUGGC AUUUCU | 54 | fU*SmC*RmA*RmA*RmG*RmG*RmA* RmA*RmG*RmA*RmU*RmG*RmG*Rm C*RmA*RmU*RmU*RmU*RmC*SfU | 649 | SRRRRRRR RRRRRRRR RRS | 1F-18OMe-1F 1Sp-17Rp-1Sp | Exon51 |
| WV-2526 | UCAAGGA AGAUGGC AUUUCU | 54 | fU*SfC*SfA*SfA*SfG*SfG*SfA*SfA*Rm G*RmA*RmU*RmG*RmG*SfC*SfA*SfU *SfU*SfU*SfC*SfU | 650 | SSSSSSSRR RRRSSSSSSS | 7F-6OMe-7F 7Sp-5Rp-7Sp | Exon51 |
| WV-2527 | UCAAGGA AGAUGGC AUUUCU | 54 | fU*SfC*SfA*SfA*SfG*SfG*SfA*SfA*Sm G*RmA*RmU*RmG*SfG*SfC*SfA*SfU* SfU*SfU*SfC*SfU | 651 | SSSSSSSSR RRSSSSSSSS | 8F-4OMe-8F 8Sp-3Rp-8Sp | Exon51 |
| WV-2528 | UCAAGGA AGAUGGC AUUUCU | 54 | fU*SfC*SfA*SfA*SfG*SfG*SfA*SfA*Sf G*SmA*RmU*SfG*SfG*SfC*SfA*SfU*S fU*SfU*SfC*SfU | 652 | SSSSSSSSSR SSSSSSSSS | 9F-2OMe-9F 9Sp-1Rp-9Sp | Exon51 |
| WV-2529 | UCAAGGA AGAUGGC AUUUCU | 54 | fU*SfC*SfA*SfA*SfG*SfG*SfA*SfAmG mAmUmGmG*SfC*SfA*SfU*SfU*SfU*S fC*SfU | 653 | SSSSSSSOO OOOSSSSSSS | 7F-6OMe-7F 7Sp-5PO-7Sp | Exon51 |
| WV-2530 | UCAAGGA AGAUGGC AUUUCU | 54 | fU*SfC*SfA*SfA*SfG*SfG*SfA*SfA*Sm GmAmUmG*SfG*SfC*SfA*SfU*SfU*Sf U*SfC*SfU | 654 | SSSSSSSSO OOSSSSSSSS | 8F-4OMe-8F 8Sp-3PO-8Sp | Exon51 |
| WV-2531 | UCAAGGA AGAUGGC AUUUCU | 54 | fU*SfC*SfA*SfA*SfG*SfG*SfA*SfA*Sf G*SmAmU*SfG*SfG*SfC*SfA*SfU*SfU *SfU*SfC*SfU | 655 | SSSSSSSSSO SSSSSSSSS | 9F-2OMe-9F 9Sp-1PO-9Sp | Exon51 |
| WV-2532 | UCAAGGA AGAUGGC AUUUCU | 54 | fU*SfC*SfA*SfA*SfG*SfG*SfA*mA*mG *mA*mU*mG*mG*fC*SfA*SfU*SfU*Sf U*SfC*SfU | 656 | SSSSSSXXX XXXXSSSSSS | 6F-8OMe-6F 6Sp-7PS-6Sp | Exon51 |
| WV-2533 | UCAAGGA AGAUGGC AUUUCU | 54 | mU*SmC*SmA*SmA*SmG*SmG*SmA* RmA*RmG*RmA*RmU*RmG*RmG*Rm C*SmA*SmU*SmU*SmU*SmC*SmU | 657 | SSSSSSRRR RRRRSSSSSS | All-OMe 6Sp-7Rp-6Sp | Exon51 |

TABLE 4-continued

Example Oligonucleotides

| WAVE ID | Base Sequence | SEQ ID NO: | Description | SEQ ID NO: | Stereochemistry[1] | Notes | Target/Program |
|---|---|---|---|---|---|---|---|
| WV-2534 | UCAAGGA AGAUGGC AUUUCU | 54 | mU*SmC*SmA*SmA*SmG*SmG*SmA* SmA*RmG*RmA*RmU*RmG*RmG*Sm C*SmA*SmU*SmU*SmU*SmC*SmU | 658 | SSSSSSSRR RRRSSSSSS | All-OMe 7Sp-5Rp-7Sp | Exon51 |
| WV-2535 | UCAAGGA AGAUGGC AUUUCU | 54 | mU*SmC*SmA*SmA*SmG*SmG*SmA* SmA*SmG*RmA*RmU*RmG*SmG*SmC *SmA*SmU*SmU*SmU*SmC*SmU | 659 | SSSSSSSSR RRSSSSSSS | All-OMe 8Sp-3Rp-8Sp | Exon51 |
| WV-2536 | UCAAGGA AGAUGGC AUUUCU | 54 | mU*SmC*SmA*SmA*SmG*SmG*SmA* SmA*SmG*SmA*RmU*SmG*SmG*SmC *SmA*SmU*SmU*SmU*SmC*SmU | 660 | SSSSSSSSSR SSSSSSSSS | All-OMe 9Sp-1Rp-95p | Exon51 |
| WV-2537 | UCAAGGA AGAUGGC AUUUCU | 54 | mU*SmC*SmA*SmA*SmG*SmG*SmA* mA*mG*mA*mU*mG*mG*mC*SmA*S mU*SmU*SmU*SmC*SmU | 661 | SSSSSSXXX XXXXSSSSSS | All-OMe 65p-7P5-65p | Exon51 |
| WV-2538 | UCAAGGA AGAUGGC AUUUCU | 54 | L001*mU*mC*mA*mA*mG*mG*mA*m A*mG*mA*mU*mG*mG*mC*mA*mU* mU*mU*mC*mU | 662 | XXXXXXX XXXXXXX XXXXXX | Drisapersen with C6 amino linker | Exon51 |
| WV-2578 | UCAAGGA AGAUGGC AUUUCU | 54 | Mod013L001*mU*mC*mA*mA*mG*mG *mA*mA*mG*mA*mU*mG*mG*mC*m A*mU*mU*mU*mC*mU | 663 | OXXXXXX XXXXXXX XXXXXXX | Drisapersen with C6 and Lauric | Exon51 |
| WV-2579 | UCAAGGA AGAUGGC AUUUCU | 54 | Mod014L001*mU*mC*mA*mA*mG*mG *mA*mA*mG*mA*mU*mG*mG*mC*m A*mU*mU*mU*mC*mU | 664 | OXXXXXX XXXXXXX XXXXXXX | Drisapersen with C6 and Myristic | Exon51 |
| WV-2580 | UCAAGGA AGAUGGC AUUUCU | 54 | Mod005L001*mU*mC*mA*mA*mG*mG *mA*mA*mG*mA*mU*mG*mG*mC*m A*mU*mU*mU*mC*mU | 665 | OXXXXXX XXXXXXX XXXXXXX | Drisapersen with C6 and Palmitic | Exon51 |
| WV-2581 | UCAAGGA AGAUGGC AUUUCU | 54 | Mod015L001*mU*mC*mA*mA*mG*mG *mA*mA*mG*mA*mU*mG*mG*mC*m A*mU*mU*mU*mC*mU | 666 | OXXXXXX XXXXXXX XXXXXXX | Drisapersen with C6 and Stearic | Exon51 |
| WV-2582 | UCAAGGA AGAUGGC AUUUCU | 54 | Mod016L001*mU*mC*mA*mA*mG*mG *mA*mA*mG*mA*mU*mG*mG*mC*m A*mU*mU*mU*mC*mU | 667 | OXXXXXX XXXXXXX XXXXXXX | Drisapersen with C6 and Oleic | Exon51 |
| WV-2583 | UCAAGGA AGAUGGC AUUUCU | 54 | Mod017L001*mU*mC*mA*mA*mG*mG *mA*mA*mG*mA*mU*mG*mG*mC*m A*mU*mU*mU*mC*mU | 668 | OXXXXXX XXXXXXX XXXXXXX | Drisapersen with C6 and Linoleic | Exon51 |
| WV-2584 | UCAAGGA AGAUGGC AUUUCU | 54 | Mod018L001*mU*mC*mA*mA*mG*mG *mA*mA*mG*mA*mU*mG*mG*mC*m A*mU*mU*mU*mC*mU | 669 | OXXXXXX XXXXXXX XXXXXXX | Drisapersen with C6 and alpha-Linolenic | Exon51 |

TABLE 4-continued

Example Oligonucleotides

| WAVE ID | Base Sequence | SEQ ID NO: | Description | SEQ ID NO: | Stereochemistry[1] | Notes | Target/Program |
|---|---|---|---|---|---|---|---|
| WV-2585 | UCAAGGA AGAUGGC AUUUCU | 54 | Mod019L001*mU*mC*mA*mA*mG*mG*mA*mA*mG*mA*mU*mG*mG*mC*mA*mU*mU*mU*mC*mU | 670 | OXXXXXX XXXXXXX XXXXXXX | Drisapersen with C6 and gamma-Linolenic | Exon51 |
| WV-2586 | UCAAGGA AGAUGGC AUUUCU | 54 | Mod006L001*mU*mC*mA*mA*mG*mG*mA*mA*mG*mA*mU*mG*mG*mC*mA*mU*mU*mU*mC*mU | 671 | OXXXXXX XXXXXXX XXXXXXX | Drisapersen with C6 and DHA | Exon51 |
| WV-2587 | UCAAGGA AGAUGGC AUUUCU | 54 | Mod020L001*mU*mC*mA*mA*mG*mG*mA*mA*mG*mA*mU*mG*mG*mC*mA*mU*mU*mU*mC*mU | 672 | OXXXXXX XXXXXXX XXXXXXX | Drisapersen with C6 and Turbinaric | Exon51 |
| WV-2588 | UCAAGGA AGAUGGC AUUUCU | 54 | Mod021*mU*mC*mA*mA*mG*mG*mA*mA*mG*mA*mU*mG*mG*mC*mA*mU*mU*mU*mC*mU | 673 | XXXXXXX XXXXXXX XXXXXX | Drisapersen with Dilinoleic | Exon51 |
| WV-2660 | UCAAGGA AGAUGGC AUUUCU | 54 | mU*mC*mA*mA*mG*mG*mAmAmGmAmUmGmGmC*mA*mU*mU*mU*mC*mU | 677 | XXXXXXO OOOOOOX XXXXX | All-OMe 6PS-7PO-6PS | Exon51 |
| WV-2661 | UCAAGGA AGAUGGC AUUUCU | 54 | mU*mC*mA*mA*mG*mG*mA*mAmGmAmUmGmG*mC*mA*mU*mU*mU*mC*mU | 678 | XXXXXXX OOOOOXX XXXXX | All-OMe 7PS-5PO-7PS | Exon51 |
| WV-2662 | UCAAGGA AGAUGGC AUUUCU | 54 | mU*mC*mA*mA*mG*mG*mA*mA*mGmAmUmG*mG*mC*mA*mU*mU*mU*mC*mU | 679 | XXXXXXX XOOOXXX XXXXX | All-OMe 8PS-3PO-8PS | Exon51 |
| WV-2663 | UCAAGGA AGAUGGC AUUUCU | 54 | mU*mC*mA*mA*mG*mG*mA*mA*mG*mAmU*mG*mG*mC*mA*mU*mU*mU*mC*mU | 680 | XXXXXXX XXOXXXX XXXXX | All-OMe 9PS-1PO-9PS | Exon51 |
| WV-2664 | UCAAGGA AGAUGGC AUUUCU | 54 | mU*SmC*SmA*SmA*SmG*SmG*SmAmAmGmAmUmGmGmC*SmA*SmU*SmU*SmU*SmC*SmU | 681 | SSSSSSOOO OOOOSSSSSS | All-OMe 6Sp-7PO-6Sp | Exon51 |
| WV-2665 | UCAAGGA AGAUGGC AUUUCU | 54 | mU*SmC*SmA*SmA*SmG*SmG*SmA*SmAmGmAmUmGmG*SmC*SmA*SmU*SmU*SmU*SmC*SmU | 682 | SSSSSSSOO OOOSSSSSSS | All-OMe 7Sp-5PO-7Sp | Exon51 |
| WV-2666 | UCAAGGA AGAUGGC AUUUCU | 54 | mU*SmC*SmA*SmA*SmG*SmG*SmA*SmA*SmGmAmUmG*SmG*SmC*SmA*SmU*SmU*SmU*SmC*SmU | 683 | SSSSSSSSO OOSSSSSSSS | All-OMe 8Sp-3PO-8Sp | Exon51 |
| WV-2667 | UCAAGGA AGAUGGC AUUUCU | 54 | mU*SmC*SmA*SmA*SmG*SmG*SmA*SmA*SmG*SmAmU*SmG*SmG*SmC*SmA*SmU*SmU*SmU*SmC*SmU | 684 | SSSSSSSSSO SSSSSSSSS | All-OMe 9Sp-1PO-9Sp | Exon51 |

TABLE 4-continued

| WAVE ID | Base Sequence | SEQ ID NO: | Description | SEQ ID NO: | Stereochemistry[1] | Notes | Target/Program |
|---|---|---|---|---|---|---|---|
| Example Oligonucleotides | | | | | | | |
| WV-2668 | UCAAGGAAGAUGGCAUUUCU | 54 | fU*fC*fA*fA*fG*fG*fA*mAmGmAmUmGmG*fC*fA*fU*fU*fU*fC*fU | 685 | XXXXXXXOOOOOXXXXXXX | 7F-6OMe-7F 7PS-5PO-7PS | Exon51 |
| WV-2669 | UCAAGGAAGAUGGCAUUUCU | 54 | fU*fC*fA*fA*fG*fG*fA*fA*mGmAmUmG*fG*fC*fA*fU*fU*fU*fC*fU | 686 | XXXXXXXXOOOXXXXXXXX | 8F-4OMe-8F 8PS-3PO-8PS | Exon51 |
| WV-2670 | UCAAGGAAGAUGGCAUUUCU | 54 | fU*fC*fA*fA*fG*fG*fA*fA*fG*mAmU*fG*fG*fC*fA*fU*fU*fU*fC*fU | 687 | XXXXXXXXXOXXXXXXXXX | 9F-2OMe-9F 9PS-1PO-9PS | Exon51 |
| WV-2737 | UCAAGGAAGAUGGCAUUUCU | 54 | fU*SfC*SfA*SfA*SfG*SfG*SmAmAmGmA*RmUmGmGmC*SfA*SfU*SfU*SfU*SfC*SfU | 690 | SSSSSSOOOROOOSSSSSS | | DMD |
| WV-2738 | UCAAGGAAGAUGGCAUUUCU | 54 | fU*SfC*SfA*SfA*SfG*SfG*SmAmAmG*RmA*RmU*RmGmGmC*SfA*SfU*SfU*SfU*SfC*SfU | 691 | SSSSSSOORRROOSSSSSS | | Exon 51 |
| WV-2739 | UCAAGGAAGAUGGCAUUUCU | 54 | fU*SfC*SfA*SfA*SfG*SfG*SmAmA*RmG*RmA*RmU*RmG*RmGmC*SfA*SfU*SfU*SfU*SfC*SfU | 692 | SSSSSSORRRRROSSSSSS | | Exon 51 |
| WV-2740 | UCAAGGAAGAUGGCAUUUCU | 54 | fU*SfC*SfA*SfA*SfG*SfG*SmA*RmA*RmGmAmUmG*RmG*RmC*SfA*SfU*SfU*SfU*SfC*SfU | 693 | SSSSSSRROOORRSSSSSS | | Exon 51 |
| WV-2741 | UCAAGGAAGAUGGCAUUUCU | 54 | fU*SfC*SfA*SfA*SfG*SfG*SmA*RmAmGmAmUmGmG*RmC*SfA*SfU*SfU*SfU*SfC*SfU | 694 | SSSSSSROOOOORSSSSSS | | Exon 51 |
| WV-2742 | UCAAGGAAGAUGGCAUUUCU | 54 | fU*SfC*SfA*SfA*SfG*SfG*SmA*SmA*SmGmAmUmG*SmG*SmC*SfA*SfU*SfU*SfU*SfC*SfU | 695 | SSSSSSSSOOOSSSSSSS | | Exon 51 |
| WV-2743 | UCAAGGAAGAUGGCAUUUCU | 54 | fU*SfC*SfA*SfA*SfG*SfG*SmA*SmAmGmAmUmGmG*SmC*SfA*SfU*SfU*SfU*SfC*SfU | 696 | SSSSSSSOOOOOSSSSSSS | | Exon 51 |
| WV-2744 | UCAAGGAAGAUGGCAUUUCU | 54 | fU*SfC*SfA*SfA*SfG*SfG*SmA*SmA*SmG*SmA*SmU*SmG*SmG*SmC*SfA*SfU*SfU*SfU*SfC*SfU | 697 | SSSSSSSSSSSSSSSSSSS | | Exon 51 |
| WV-2745 | UCAAGGAAGAUGGCAUUUCU | 54 | fU*SfC*SfA*SfA*SfG*SfG*SmAmAmGmAfU*SmGmG*SfC*SfA*SfU*SfU*SfU*SfC*SfU | 698 | SSSSSSOOOOSOSSSSSSS | | Exon 51 |

TABLE 4-continued

| Example Oligonucleotides | | | | | | | |
|---|---|---|---|---|---|---|---|
| WAVE ID | Base Sequence | SEQ ID NO: | Description | SEQ ID NO: | Stereochemistry[1] | Notes | Target/Program |
| WV-2746 | UCAAGGA AGAUGGC AUUUCU | 54 | fU*SfC*SfA*SfA*SfG*SfG*SmA*RmA* RmG*RmA*RfU*SmG*RmG*SfC*SfA*S fU*SfU*SfU*SfC*SfU | 699 | SSSSSSRRR RSRSSSSSS | | Exon 51 |
| WV-2747 | UCAAGGA AGAUGGC AUUUCU | 54 | fU*SfC*SfA*SfA*SmG*SmG*SfAfAmG mAfU*SmGmG*SfC*SfA*SfU*SfU*SfU* SfC*SfU | 700 | SSSSSSOOO OSOSSSSSS | | Exon 51 |
| WV-2748 | UCAAGGA AGAUGGC AUUUCU | 54 | fU*SfC*SfA*SfA*SmG*SmG*SfA*RfA* RmG*RmA*RfU*SmG*RmG*SfC*SfA*S fU*SfU*SfU*SfC*SfU | 701 | SSSSSSRRR RSRSSSSSS | | Exon 51 |
| WV-2749 | UCAAGGA AGAUGGC AUUUCU | 54 | fU*SfC*SfA*SfA*SfG*SfG*SfA*SmAmG mAmUmGmG*SfC*SfA*SfU*SfU*SfU*S fC*SfU | 702 | SSSSSSSOO OOOSSSSSS | | Exon 51 |
| WV-2750 | UCAAGGA AGAUGGC AUUUCU | 54 | fU*SfC*SfA*SfA*SfG*SfG*SfA*SmA*R mG*RmA*RmU*RmG*RmG*SfC*SfA*Sf U*SfU*SfU*SfC*SfU | 703 | SSSSSSSRR RRRSSSSSS | | Exon 51 |
| WV-2791 | UCAAGGA AGAUGGC AUUUCU | 54 | mU*SmC*SmA*SfA*SfG*SfG*SmA*Rm A*RmG*RmA*RmU*RmG*RmG*RmC*S fA*SfU*SfU*SmU*SmC*SmU | 704 | SSSSSSRRR RRRRSSSSS | | Exon 51 |
| WV-2792 | UCAAGGA AGAUGGC AUUUCU | 54 | mU*SmC*SmA*SfA*SfG*SfG*SfA*SmA *RmG*RmA*RmU*RmG*RmG*SfC*SfA *SfU*SfU*SmU*SmC*SmU | 705 | SSSSSSSRR RRRSSSSSS | | Exon 51 |
| WV-2793 | UCAAGGA AGAUGGC AUUUCU | 54 | mU*SmC*SmA*SfA*SfG*SfG*SfA*SfA* SmG*RmA*RmU*RmG*SfG*SfC*SfA*Sf U*SfU*SmU*SmC*SmU | 706 | SSSSSSSSR RRSSSSSSS | | Exon 51 |
| WV-2794 | UCAAGGA AGAUGGC AUUUCU | 54 | mU*SmC*SmA*SfA*SfG*SfG*SfA*SfA* SfG*SmA*RmU*SfG*SfG*SfC*SfA*SfU *SfU*SmU*SmC*SmU | 707 | SSSSSSSSSR SSSSSSSSS | | Exon 51 |
| WV-2795 | UCAAGGA AGAUGGC AUUUCU | 54 | mU*SmC*SmA*SfA*SfG*SfG*SfA*SfA* SmGmAmUmG*SfG*SfC*SfA*SfU*SfU* SmU*SmC*SmU | 708 | SSSSSSSSO OOSSSSSSS | Hybrid of WV-887 and WV-2444; OMethyl, Sp and F, Sp on the wings and OMethyl, PO in the core | Exon 51 |
| WV-2796 | UCAAGGA AGAUGGC AUUUCU | 54 | mU*SmC*SmA*SfA*SfG*SfG*SfA*SfA* SfG*SmAmU*SfG*SfG*SfC*SfA*SfU*Sf U*SmU*SmC*SmU | 709 | SSSSSSSSSO SSSSSSSSS | hybrid of WV-887 and WV-2444; OMethyl, Sp and F, Sp on the wings and OMethyl, PO in the core | Exon 51 |

TABLE 4-continued

| Example Oligonucleotides | | | | | | | |
|---|---|---|---|---|---|---|---|
| WAVE ID | Base Sequence | SEQ ID NO: | Description | SEQ ID NO: | Stereochemistry[1] | Notes | Target/Program |
| WV-2797 | UCAAGGAAGAUGGCAUUUCU | 54 | fU*fC*fA*fA*fG*fG*fA*fA*mG*mA*mU*mG*mG*fC*fA*fU*fU*fU*fC*fU | 711 | XXXXXXXXXXXXXXXXXXX | randomer based on WV-2526 | DMD |
| WV-2798 | UCAAGGAAGAUGGCAUUUCU | 54 | fU*fC*fA*fA*fG*fG*fA*fA*mG*mA*mU*mG*fG*fC*fA*fU*fU*fU*fC*fU | 712 | XXXXXXXXXXXXXXXXXXX | randomer based on WV-2527 | DMD |
| WV-2799 | UCAAGGAAGAUGGCAUUUCU | 54 | fU*fC*fA*fA*fG*fG*fA*fA*fG*mA*mU*fG*fG*fC*fA*fU*fU*fU*fC*fU | 713 | XXXXXXXXXXXXXXXXXXX | randomer based on WV-2528 | DMD |
| WV-2800 | UCAAGGAAGAUGGCAUUUCU | 54 | fU*fC*fA*fA*fG*fG*fA*mA*mG*mA*mU*mG*mG*fC*fA*fU*fU*fU*fC*fU | 714 | XXXXXXXXXXXXXXXXXXX | randomer based on WV-2750 | DMD |
| WV-2801 | UCAAGGAAGAUGGCAUUUCU | 54 | mU*mC*mA*fA*fG*fG*mA*mA*mG*mA*mU*mG*mG*mC*fA*fU*fU*mU*mC*mU | 715 | XXXXXXXXXXXXXXXXXXX | randomer based on WV-2791 | DMD |
| WV-2802 | UCAAGGAAGAUGGCAUUUCU | 54 | mU*mC*mA*fA*fG*fG*fA*mA*mG*mA*mU*mG*mG*fC*fA*fU*fU*mU*mC*mU | 716 | XXXXXXXXXXXXXXXXXXX | randomer based on WV-2792 | DMD |
| WV-2803 | UCAAGGAAGAUGGCAUUUCU | 54 | mU*mC*mA*fA*fG*fG*fA*fA*mG*mA*mU*mG*fG*fC*fA*fU*fU*mU*mC*mU | 717 | XXXXXXXXXXXXXXXXXXX | randomer based on WV-2793 | DMD |
| WV-2804 | UCAAGGAAGAUGGCAUUUCU | 54 | mU*mC*mA*fA*fG*fG*fA*fA*fG*mA*mU*fG*fG*fC*fA*fU*fU*mU*mC*mU | 718 | XXXXXXXXXXXXXXXXXXX | randomer based on WV-2794 | DMD |
| WV-2805 | UCAAGGAAGAUGGCAUUUCU | 54 | mU*mC*mA*fA*fG*fG*fA*fA*mGmAmUmG*fG*fC*fA*fU*fU*mU*mC*mU | 719 | XXXXXXXXOOOXXXXXXXX | randomer based on WV-2795 | DMD |
| WV-2806 | UCAAGGAAGAUGGCAUUUCU | 54 | mU*mC*mA*fA*fG*fG*fA*fA*fG*mAmU*fG*fG*fC*fA*fU*fU*mU*mC*mU | 720 | XXXXXXXXXOXXXXXXXXX | randomer based on WV-2796 | DMD |
| WV-2807 | UCAAGGAAGAUGGCAUUUCU | 54 | Mod024L001*mU*mC*mA*mA*mG*mG*mA*mA*mG*mA*mU*mG*mG*mC*mA*mU*mU*mU*mC*mU | 721 | XXXXXXXXXXXXXXXXXXXX | All-OMe full-PS TriGlcNAc conjugated WV942 C6 PS | Exon 51 |
| WV-2808 | UCAAGGAAGAUGGCAUUUCU | 54 | Mod026L001*mU*mC*mA*mA*mG*mG*mA*mA*mG*mA*mU*mG*mG*mC*mA*mU*mU*mU*mC*mU | 722 | XXXXXXXXXXXXXXXXXXXX | All-OMe full-PS TrialphaMannose conjugated WV942 C6 PS | Exon 51 |

TABLE 4-continued

Example Oligonucleotides

| WAVE ID | Base Sequence | SEQ ID NO: | Description | SEQ ID NO: | Stereochemistry[1] | Notes | Target/Program |
|---|---|---|---|---|---|---|---|
| WV-2812 | UCAAGGA AGATGGC AUUUCU | 258 | fU*fC*fA*fA*fG*fG*mA*mA*mG*mA* BrdU*mG*mG*mC*fA*fU*fU*fU*fC*fU | 723 | XXXXXXX XXXXXXX XXXXX | WV-1714 based BrdU in the center | DMD exon 51 |
| WV-2813 | UCAAGGA AGATGGC AUUUCU | 258 | fU*fC*fA*fA*fG*fG*fA*fA*fG*mA*Brd U*fG*fG*fC*fA*fU*fU*fU*fC*fU | 724 | XXXXXXX XXXXXXX XXXXX | WV-2528 and WV-2799 based randomer BrdU in the center | DMD exon 51 |
| WV-2814 | UCAAGGA AGATGGC AUUUCU | 258 | mU*mC*mA*mA*mG*mG*mA*mA*mG *mA*BrdU*mG*mG*mC*mA*mU*mU* mU*mC*mU | 725 | XXXXXXX XXXXXXX XXXXX | WV-942 based BrdU in the center | DMD exon 51 |
| WV-3017 | UCAAGGA AGATGGC AUUUCU | 258 | fU*SfC*SfA*SfA*SfG*SfG*SfA*SfA*Sm GmABrdUmG*SfG*SfC*SfA*SfU*SfU*S fU*SfC*SfU | 726 | SSSSSSSSO OOSSSSSSSS | WV-2530 based, BrdU in the middle | Exon 51 |
| WV-3018 | UCAAGGA AGATGGC AUUUCU | 258 | fU*fC*fA*fA*fG*fG*fA*fA*mGmABrdU mG*fG*fC*fA*fU*fU*fU*fC*fU | 727 | XXXXXXX XOOOXXX XXXXX | WV-2530 based, randomer, BrdU in the middle | Exon 51 |
| WV-3019 | UCAAGGA AGATGGC AUUUCU | 258 | fU*SfC*SfA*SfA*SfG*SfG*SmAmAmG mABrdUmGmGmC*SfA*SfU*SfU*SfU*S fC*SfU | 728 | SSSSSSOOO OOOOSSSSSS | WV-2438 based, BrdU in the middle | Exon 51 |
| WV-3020 | UCAAGGA AGATGGC AUUUCU | 258 | fU*fC*fA*fA*fG*fG*mAmAmGmABrdU mGmGmC*fA*fU*fU*fU*fC*fU | 729 | XXXXXXO OOOOOOX XXXXX | WV-2438 based, randomer, BrdU in the middle | Exon 51 |
| WV-3022 | UCAAGGA AGAUGGC AUUUCU | 54 | L001*fU*SfC*SfA*SfA*SfG*SfG*SmAm AmGmAmUmGmGmC*SfA*SfU*SfU*Sf U*SfC*SfU | 730 | XSSSSSSOO OOOOOSSS SSS | WV-2438 based; C6 PS; on support; used for conjugation | DMD |
| WV-3023 | UCAAGGA AGAUGGC AUUUCU | 54 | Mod015L001*fU*SfC*SfA*SfA*SfG*SfG *SmAmAmGmAmUmGmGmC*SfA*SfU* SfU*SfU*SfC*SfU | 731 | OXSSSSSSO OOOOOOSS SSSS | WV-2438 based; conjugate with stearic acid C6 PS | DMD |
| WV-3024 | UCAAGGA AGAUGGC AUUUCU | 54 | Mod006L001*fU*SfC*SfA*SfA*SfG*SfG *SmAmAmGmAmUmGmGmC*SfA*SfU* SfU*SfU*SfC*SfU | 732 | OXSSSSSSO OOOOOOSS SSSS | WV-2438 based; conjugate with DHA C6 PS | DMD |
| WV-3025 | UCAAGGA AGAUGGC AUUUCU | 54 | L001*fU*SfC*SfA*SfA*SfG*SfG*SfA*Sf A*SmGmAmUmG*SfG*SfC*SfA*SfU*Sf U*SfU*SfC*SfU | 733 | XSSSSSSSS OOOSSSSSS SS | WV-2530 based; C6 PS; on support; used for conjugation | DMD |
| WV-3026 | UCAAGGA AGAUGGC AUUUCU | 54 | Mod015L001*fU*SfC*SfA*SfA*SfG*SfG *SfA*SfA*SmGmAmUmG*SfG*SfC*SfA *SfU*SfU*SfU*SfC*SfU | 734 | OXSSSSSSS SOOOSSSSS SSS | WV-2530 based; conjugate with stearic acid C6 PS | DMD |

TABLE 4-continued

Example Oligonucleotides

| WAVE ID | Base Sequence | SEQ ID NO: | Description | SEQ ID NO: | Stereochemistry[1] | Notes | Target/Program |
|---|---|---|---|---|---|---|---|
| WV-3027 | UCAAGGA AGAUGGC AUUUCU | 54 | Mod006L001*fU*SfC*SfA*SfA*SfG*SfG *SfA*SfA*SmGmAmUmG*SfG*SfC*SfA *SfU*SfU*SfU*SfC*SfU | 735 | OXSSSSSS SOOOSSSSS SSS | WV-2530 based; conjugate with DHA C6 PS | DMD |
| WV-3028 | UCAAGGA AGAUGGC AUUUCU | 54 | fU*SfC*SfA*SfA*SfG*SfG*SfA*SfA*Sm GmAmUmGmG*SfC*SfA*SfU*SfU*SfU* SfC*SfU | 736 | SSSSSSSSO OOOSSSSSSS | WV-2529 based, convert PO between 8th and 9th nt to PS | DMD |
| WV-3029 | UCAAGGA AGAUGGC AUUUCU | 54 | L001*fU*fC*fA*fA*fG*fG*mA*mA*mG *mA*mU*mG*mG*mC*fA*fU*fU*fU*fC *fu | 737 | XXXXXXX XXXXXXX XXXXXX | WV-1714 based; stereorandom; C6 PS; on support | DMD |
| WV-3030 | UCAAGGA AGAUGGC AUUUCU | 54 | Mod015L001*fU*fC*fA*fA*fG*fG*mA* mA*mG*mA*mU*mG*mG*mC*fA*fU*f U*fU*fC*fU | 738 | OXXXXXX XXXXXXX XXXXXXX | WV-1714 based; stereorandom; conjugate with stearic acid C6 PS | DMD |
| WV-3031 | UCAAGGA AGAUGGC AUUUCU | 54 | Mod006L001*fU*fC*fA*fA*fG*fG*mA* mA*mG*mA*mU*mG*mG*mC*fA*fU*f U*fU*fC*fU | 739 | OXXXXXX XXXXXXX XXXXXXX | WV-1714 based; stereorandom; conjugate with DHA C6 PS | DMD |
| WV-3032 | UCAAGGA AGAUGGC AUUUCU | 54 | Mod020L001*fU*fC*fA*fA*fG*fG*mA* mA*mG*mA*mU*mG*mG*mC*fA*fU*f U*fU*fC*fU | 740 | OXXXXXX XXXXXXX XXXXXXX | WV-1714 based; stereorandom; conjugate with turbinaric acid C6 PS | DMD |
| WV-3033 | UCAAGGA AGAUGGC AUUUCU | 54 | Mod019L001*fU*fC*fA*fA*fG*fG*mA* mA*mG*mA*mU*mG*mG*mC*fA*fU*f U*fU*fC*fU | 741 | OXXXXXX XXXXXXX XXXXXXX | WV-1714 based; stereorandom; conjugate with gamma-Linolenic acid C6 PS | DMD |
| WV-3034 | UCAAGGA AGAUGGC AUUUCU | 54 | L001*fU*fC*fA*fA*fG*fG*fA*fA*mGm AmUmG*fG*fC*fA*fU*fU*fU*fC*fU | 742 | XXXXXXX XXOOOXX XXXXXX | WV-2530 based; stereorandom; C6 PS; on support | DMD |
| WV-3035 | UCAAGGA AGAUGGC AUUUCU | 54 | Mod015L001*fU*fC*fA*fA*fG*fG*fA*f A*mGmAmUmG*fG*fC*fA*fU*fU*fU*f C*fU | 743 | OXXXXXX XXXOOOX XXXXXXX | WV-2530 based; stereorandom; conjugate with stearic acid C6 PS | DMD |
| WV-3036 | UCAAGGA AGAUGGC AUUUCU | 54 | Mod006L001*fU*fC*fA*fA*fG*fG*fA*f A*mGmAmUmG*fG*fC*fA*fU*fU*fU*f C*fU | 744 | OXXXXXX XXXOOOX XXXXXXX | WV-2530 based; stereorandom; conjugate with DHA C6 PS | DMD |
| WV-3037 | UCAAGGA AGAUGGC AUUUCU | 54 | Mod020L001*fU*fC*fA*fA*fG*fG*fA*f A*mGmAmUmG*fG*fC*fA*fU*fU*fU*f C*fU | 745 | OXXXXXX XXXOOOX XXXXXXX | WV-2530 based; stereorandom; conjugate with turbinaric acid C6 PS | DMD |

TABLE 4-continued

| Example Oligonucleotides | | | | | | | |
|---|---|---|---|---|---|---|---|
| WAVE ID | Base Sequence | SEQ ID NO: | Description | SEQ ID NO: | Stereochemistry[1] | Notes | Target/Program |
| WV-3038 | UCAAGGAAGAUGGCAUUUCU | 54 | Mod019L001*fU*fC*fA*fA*fG*fG*fA*fA*mGmAmUmG*fG*fC*fA*fU*fU*fU*fC*fU | 746 | OXXXXXXXXXOOOXXXXXXXX | WV-2530 based; stereorandom; conjugate with gamma-Linolenic acid C6 PS | DMD |
| WV-3039 | UCAAGGAAGAUGGCAUUUCU | 54 | fU*fC*fA*fA*fG*fG*mAmAmGmA*mUmGmGmC*fA*fU*fU*fU*fC*fU | 747 | XXXXXXOOOXOOOXXXXXX | Randomer of WV-2737; based on WV-2438; with Rp/PO in the core | DMD exon 51 |
| WV-3040 | UCAAGGAAGAUGGCAUUUCU | 54 | fU*fC*fA*fA*fG*fG*mAmAmG*mA*mU*mGmGmC*fA*fU*fU*fU*fC*fU | 748 | XXXXXXOOXXXOOXXXXXX | Randomer of WV-2738; based on WV-2438; with Rp/PO in the core | DMD exon 51 |
| WV-3041 | UCAAGGAAGAUGGCAUUUCU | 54 | fU*fC*fA*fA*fG*fG*mAmA*mG*mA*mU*mG*mGmC*fA*fU*fU*fU*fC*fU | 749 | XXXXXXOXXXXXOXXXXXX | Randomer of WV-2739; based on WV-2438; with Rp/PO in the core | DMD exon 51 |
| WV-3042 | UCAAGGAAGAUGGCAUUUCU | 54 | fU*fC*fA*fA*fG*fG*mA*mA*mGmAmUmG*mG*mC*fA*fU*fU*fU*fC*fU | 750 | XXXXXXXXOOOXXXXXXX | Randomer of WV-2740; based on WV-2438; with Rp/PO in the core | DMD exon 51 |
| WV-3043 | UCAAGGAAGAUGGCAUUUCU | 54 | fU*fC*fA*fA*fG*fG*mA*mAmGmAmUmGmG*mC*fA*fU*fU*fU*fC*fU | 751 | XXXXXXXOOOOOXXXXXXX | Randomer of WV-2741; based on WV-2438; with Rp/PO in the core | DMD exon 51 |
| WV-3044 | UCAAGGAAGAUGGCAUUUCU | 54 | fU*fC*fA*fA*fG*fG*mA*mA*mGmAmUmG*mG*mC*fA*fU*fU*fU*fC*fU | 752 | XXXXXXXXOOOXXXXXXX | Randomer of WV-2742; based on WV-2438; with Sp/PO in the core | DMD exon 51 |
| WV-3045 | UCAAGGAAGAUGGCAUUUCU | 54 | fU*fC*fA*fA*fG*fG*mA*mAmGmAmUmGmG*mC*fA*fU*fU*fU*fC*fU | 753 | XXXXXXXOOOOOXXXXXXX | Randomer of WV-2743; based on WV-2438; with Sp/PO in the core | DMD exon 51 |
| WV-3046 | UCAAGGAAGAUGGCAUUUCU | 54 | fU*fC*fA*fA*fG*fG*mAmAmGmAfU*mGmG*fC*fA*fU*fU*fU*fC*fU | 754 | XXXXXXOOOOXOXXXXXXX | Randomer of WV-2745; based on WV-2444; Sp/PO in the core; with additional fU fC in the core | DMD exon 51 |
| WV-3047 | UCAAGGAAGAUGGCAUUUCU | 54 | fU*fC*fA*fA*fG*fG*mA*mA*mG*mA*fU*mG*mG*fC*fA*fU*fU*fU*fC*fU | 755 | XXXXXXXXXXXXXXXXXXX | Randomer of WV-2746; based on WV-2444; Sp/Rp in the core; with additional fU fC in the core | DMD exon 51 |

TABLE 4-continued

| Example Oligonucleotides | | | | | | | |
|---|---|---|---|---|---|---|---|
| WAVE ID | Base Sequence | SEQ ID NO: | Description | SEQ ID NO: | Stereochemistry[1] | Notes | Target/Program |
| WV-3048 | UCAAGGA AGAUGGC AUUUCU | 54 | fU*fC*fA*fA*mG*mG*fAfAmGmAfU*mGmG*fC*fA*fU*fU*fU*fC*fU | 756 | XXXXXXO OOOXOXX XXXXX | Randomer of WV-2747; based on WV-2444; Sp/PO in the core; with mGmG on left wing, with additional fA fA fU fC in the core | DMD exon 51 |
| WV-3049 | UCAAGGA AGAUGGC AUUUCU | 54 | fU*fC*fA*fA*mG*mG*fA*fA*mG*mA*fU*mG*mG*fC*fA*fU*fU*fU*fC*fU | 757 | XXXXXXX XXXXXXX XXXXX | Randomer of WV-2748; based on WV-2444; Sp/Rp in the core; with mGmG on left wing, with additional fA fA fU fC in the core | DMD exon 51 |
| WV-3050 | UCAAGGA AGAUGGC AUUUCU | 54 | fU*fC*fA*fA*fG*fG*mA*mA*mG*mA*fU*mG*mG*fC*fA*fU*fU*fU*fC*fU | 758 | XXXXXXX XXXXXXX XXXXX | All PS version of the randomer of WV-2745/2746; based on WV-2444; with additional fU fC in the core | DMD exon 51 |
| WV-3051 | UCAAGGA AGAUGGC AUUUCU | 54 | fU*fC*fA*fA*mG*mG*fA*fA*mG*mA*fU*mG*mG*fC*fA*fU*fU*fU*fC*fU | 759 | XXXXXXX XXXXXXX XXXXX | All PS version of the randomer of WV-2747/2748; based on WV-2444; Sp/PO in the core; with mGmG on left wing, with additional fA fA fU fC in the core | DMD exon 51 |
| WV-3052 | UCAAGGA AGAUGGC AUUUCU | 54 | fU*fC*fA*fA*mG*mG*fA*fA*mGmAmUmG*mG*fC*fA*fU*fU*fU*fC*fU | 760 | XXXXXXX XOOOXXX XXXXX | Based on WV-2530; replace all 2'F G with 2'Ome G | DMD exon 51 |
| WV-3053 | UCAAGGA AGAUGGC AUUUCU | 54 | fU*fC*fA*fA*mG*mG*mA*mA*mGmAfUmG*mG*fC*fA*fU*fU*fU*fC*fU | 761 | XXXXXXX XOOOXXX XXXXX | Based on WV-2107; four 2'-F on the 5'; seven 2'-F on the 3'; 2'F U in the center | DMD exon 51 |
| WV-3054 | UCAAGGA AGAUGGC AUUUCU | 54 | fU*fC*fA*fA*mG*mG*fA*fA*mG*mA*mU*mG*mG*fC*fA*fU*fU*fU*fC*fU | 762 | XXXXXXX XXXXXXX XXXXX | All PS; based on WV-2530/2529; replace all 2'F G with 2'Ome G | DMD exon 51 |
| WV-3055 | UCAAGGA AGAUGGC AUUUCU | 54 | fU*fC*fA*fA*mG*mG*mA*mA*mG*mA*fU*mG*mG*fC*fA*fU*fU*fU*fC*fU | 763 | XXXXXXX XXXXXXX XXXXX | All PS; based on WV-2107; four 2'-F on the 5'; seven 2'-F on the 3'; 2'F U in the center | DMD exon 51 |

TABLE 4-continued

| Example Oligonucleotides | | | | | | | |
|---|---|---|---|---|---|---|---|
| WAVE ID | Base Sequence | SEQ ID NO: | Description | SEQ ID NO: | Stereochemistry[1] | Notes | Target/Program |
| WV-3056 | UCAAGGA AGAUGGC AUUUCU | 54 | fU*fC*fA*fA*mG*mG*fAfAmGmA*fU* mGmG*fC*fA*fU*fU*fU*fC*fU | 764 | XXXXXXO OOXXOXX XXXXX | Based on WV-2747; with additional PS in the center between A and U | DMD exon 51 |
| WV-3057 | UCAAGGA AGAUGGC AUUUCU | 54 | fU*fC*fA*fA*mG*mG*fA*fA*mG*mA*f U*mG*mG*fC*fA*fU*fU*fU*fC*fU | 765 | XXXXXXX XXXXXXX XXXXX | All PS version; based on WV-2747; with additional PS in the center between A and U | DMD exon 51 |
| WV-3058 | UCAAGGA AGAUGGC AUUUCU | 54 | fU*fC*fA*fA*mG*mG*fA*fA*mG*fA*f U*mG*mG*fC*fA*fU*fU*fU*fC*fU | 766 | XXXXXXX XXXXXXX XXXXX | Based on WV-1716; with all mC converted to fC | DMD exon 51 |
| WV-3059 | UCAAGGA AGAUGGC AUUUCU | 54 | fU*fC*fA*fA*mG*mG*fA*fA*mGmAm UmGmG*fC*fA*fU*fU*fU*fC*fU | 767 | XXXXXXX XOOOOXX XXXXX | Randomers of based on WV-2529; with all G as mG; with additional PS between A and G | DMD exon 51 |
| WV-3060 | UCAAGGA AGAUGGC AUUUCU | 54 | fU*fC*fA*fA*mG*mG*fA*fA*mGmAfU *mGmG*fC*fA*fU*fU*fU*fC*fU | 768 | XXXXXXX XOOXOXX XXXXX | Randomer; Sp/PO in the core; with mGmG on left wing, with additional fA fA fU fC in the core | DMD exon 51 |
| WV-3061 | UCAAGGA AGAUGGC AUUUCU | 54 | fU*fC*fA*fA*mG*mG*mA*mA*mGmAf U*mGmG*fC*fA*fU*fU*fU*fC*fU | 769 | XXXXXXX XOOXOXX XXXXX | Based on WV-2107; four 2'-F on the 5'; seven 2'-F on the 3'; 2'F U in the center | DMD exon 51 |
| WV-3070 | UCAAGGA AGAUGGC AUUUCU | 54 | fU*SfC*SfA*SfA*SfG*SfG*SmAmAmG mAmU:mGmGmC*SfA*SfU*SfU*SfU*Sf C*SfU | 770 | SSSSSSOOO ODOOSSSSSS | WV-2438 based, with PS2 after nucleotide 11 | Exon 51 |
| WV-3071 | UCAAGGA AGAUGGC AUUUCU | 54 | fU*SfC*SfA*SfA*SfG*SfG*SmAmA:mG mA:mUmG:mGmC*SfA*SfU*SfU*SfU*S fC*SfU | 771 | SSSSSSODO DODOSSSSSS | WV-2438 based, with PS2 after nucleotide 8, 10, 12 | Exon 51 |
| WV-3072 | UCAAGGA AGAUGGC AUUUCU | 54 | fU*SfC*SfA*SfA*SfG*SfG*SmA:mAmG: mAmU:mGmG:mC*SfA*SfU*SfU*SfU*S fC*SfU | 772 | SSSSSSDOD ODODSSSSSS | WV-2438 based, with PS2 after nucleotide 7, 9, 11, 13 | Exon 51 |
| WV-3073 | UCAAGGA AGAUGGC AUUUCU | 54 | fU*SfC*SfA*SfA*SfG*SfG*SmA:mAmG mAmU:mGmG:mC*SfA*SfU*SfU*SfU*S fC*SfU | 773 | SSSSSSDOO ODODSSSSSS | WV-2438 based, with PS2 after nucleotide 7, 10, 13 | Exon 51 |
| WV-3074 | UCAAGGA AGAUGGC AUUUCU | 54 | fU*SfC*SfA*SfA*fG:fG:mAmAmGmAm U:mGmGmC*SfA*SfU*SfU*SfU*SfC*SfU | 774 | SSSXDDOO OODOOSSS SSS | WV-2438 based, with PS2 after nucleotide 11; two SfG * on 5' wing converted to fG-PS2 | Exon 51 |

TABLE 4-continued

| Example Oligonucleotides | | | | | | | |
|---|---|---|---|---|---|---|---|
| WAVE ID | Base Sequence | SEQ ID NO: | Description | SEQ ID NO: | Stereochemistry[1] | Notes | Target/Program |
| WV-3075 | UCAAGGAAGAUGGCAUUUCU | 54 | fU*SfC*SfA*SfA*mG:mG:mAmAmGmAmU:mGmGmC*SfA*SfU*SfU*SfU*SfC*SfU | 775 | SSSXDDOOOODOOSSSSSS | WV-2438 based, with PS2 after nucleotide 11; two SfG * on 5' wing converted to mG-PS2 | Exon 51 |
| WV-3076 | UCAAGGAAGAUGGCAUUUCU | 54 | fU*SfC*SfA*SfA*SfG*SfG*SfA*SmAmGmAmU:mGmG*SfC*SfA*SfU*SfU*SfU*SfC*SfU | 776 | SSSSSSSOOODOSSSSSSS | WV-2749 based, with PS2 after nucleotide 11 | Exon 51 |
| WV-3077 | UCAAGGAAGAUGGCAUUUCU | 54 | fU*SfC*SfA*SfA*fG:fG:fA*SmAmGmAmU:mGmG*SfC*SfA*SfU*SfU*SfU*SfC*SfU | 777 | SSSXDDSOOODOSSSSSSS | WV-2749 based, with PS2 after nucleotide 11; two SfG * on 5' wing converted to fG-PS2 | Exon 51 |
| WV-3078 | UCAAGGAAGAUGGCAUUUCU | 54 | fU*SfC*SfA*SfA*mG:mG:fA*SmAmGmAmU:mGmG*SfC*SfA*SfU*SfU*SfU*SfC*SfU | 778 | SSSXDDSOOODOSSSSSSS | WV-2749 based, with PS2 after nucleotide 11; two SfG * on 5' wing converted to mG-PS2 | Exon 51 |
| WV-3079 | UCAAGGAAGAUGGCAUUUCU | 54 | fU*SfC*SfA*SfA*SfG*SfG*SfA*SfA*SmGmAmU:mG*SfG*SfC*SfA*SfU*SfU*SfU*SfC*SfU | 779 | SSSSSSSSOODSSSSSSSS | WV-2530 based, with PS2 after nucleotide 11 | Exon 51 |
| WV-3080 | UCAAGGAAGAUGGCAUUUCU | 54 | fU*SfC*SfA*SfA*SfG*SfG*SfA*SfA*SmG:mA:mU:mG*SfG*SfC*SfA*SfU*SfU*SfU*SfC*SfU | 780 | SSSSSSSSDDDSSSSSSSS | WV-2530 based, with PS2 after nucleotide 9, 10, 11 | Exon 51 |
| WV-3081 | UCAAGGAAGAUGGCAUUUCU | 54 | fU*SfC*SfA*SfA*SfG*SfG*SfA*SfA*SmG:mAmU:mG*SfG*SfC*SfA*SfU*SfU*SfU*SfC*SfU | 781 | SSSSSSSSDODSSSSSSSS | WV-2530 based, with PS2 after nucleotide 9, 11 | Exon 51 |
| WV-3082 | UCAAGGAAGAUGGCAUUUCU | 54 | fU*SfC*SfA*SfA*fG:fG:fA*SfA*SmGmAmU:mG*SfG*SfC*SfA*SfU*SfU*SfU*SfC*SfU | 782 | SSSXDDSSOODSSSSSSSS | WV-2530 based, with PS2 after nucleotide 11; two SfG * on 5' wing converted to fG-PS2 | Exon 51 |
| WV-3083 | UCAAGGAAGAUGGCAUUUCU | 54 | fU*SfC*SfA*SfA*mG:mG:fA*SfA*SmGmAmU:mG*SfG*SfC*SfA*SfU*SfU*SfU*SfC*SfU | 783 | SSSXDDSSOODSSSSSSSS | WV-2530 based, with PS2 after nucleotide 11; two SfG * on 5' wing converted to mG-PS2 | Exon 51 |
| WV-3084 | UCAAGGAAGAUGGCAUUUCU | 54 | Mod015L001mU*mC*mA*mA*mG*mG*mA*mA*mG*mA*mU*mG*mG*mC*mA*mU*mU*mU*mC*mU | 784 | OOXXXXXXXXXXXXXXXXXXX | WV942 with C6 PO and Stearic | Exon 51 |
| WV-3085 | UCAAGGAAGAUGGCAUUUCU | 54 | Mod019L001mU*mC*mA*mA*mG*mG*mA*mA*mG*mA*mU*mG*mG*mC*mA*mU*mU*mU*mC*mU | 785 | OOXXXXXXXXXXXXXXXXXXX | WV942 with C6 PO and gamma-Linolenic | Exon 51 |

TABLE 4-continued

| Example Oligonucleotides | | | | | | | |
|---|---|---|---|---|---|---|---|
| WAVE ID | Base Sequence | SEQ ID NO: | Description | SEQ ID NO: | Stereochemistry[1] | Notes | Target/Program |
| WV-3086 | UCAAGGAAGAUGGCAUUUCU | 54 | Mod020L001mU*mC*mA*mA*mG*mG*mA*mA*mG*mA*mU*mG*mG*mC*mA*mU*mU*mU*mC*mU | 786 | OOXXXXXXXXXXXXXXXXXXX | WV942 with C6 PO and Turbinaric | Exon 51 |
| WV-3087 | UCAAGGAAGAUGGCAUUUCU | 54 | Mod015L001:mU*mC*mA*mA*mG*mG*mA*mA*mG*mA*mU*mG*mG*mC*mA*mU*mU*mU*mC*mU | 787 | ODXXXXXXXXXXXXXXXXXXX | WV942 with C6 PS2 and Stearic | Exon 51 |
| WV-3088 | UCAAGGAAGAUGGCAUUUCU | 54 | Mod019L001:mU*mC*mA*mA*mG*mG*mA*mA*mG*mA*mU*mG*mG*mC*mA*mU*mU*mU*mC*mU | 788 | ODXXXXXXXXXXXXXXXXXXX | WV942 with C6 PS2 and gamma-Linolenic | Exon 51 |
| WV-3089 | UCAAGGAAGAUGGCAUUUCU | 54 | Mod020L001:mU*mC*mA*mA*mG*mG*mA*mA*mG*mA*mU*mG*mG*mC*mA*mU*mU*mU*mC*mU | 789 | ODXXXXXXXXXXXXXXXXXXX | WV942 with C6 PS2 and Turbinaric | Exon 51 |
| WV-3113 | UCAAGGAAGAUGGCAUUUCU | 54 | fU*SfC*SfA*SfA*SfG:fG:mAmAmGmAmU:mGmGmC*SfA*SfU*SfU*SfU*SfC*SfU | 790 | SSSSDDOOOODOOSSSSSS | Variant of WV-3074. There was a randomer PS in WV-3074 | Exon 51 |
| WV-3114 | UCAAGGAAGAUGGCAUUUCU | 54 | fU*SfC*SfA*SfA*SmG:mG:mAmAmGmAmU:mGmGmC*SfA*SfU*SfU*SfU*SfC*SfU | 791 | SSSSDDOOOODOOSSSSSS | Variant of WV-3075. There was a randomer PS in WV-3075 | Exon 51 |
| WV-3115 | UCAAGGAAGAUGGCAUUUCU | 54 | fU*SfC*SfA*SfA*SfG:fG:fA*SmAmGmAmU:mGmG*SfC*SfA*SfU*SfU*SfU*SfC*SfU | 792 | SSSSDDSOOODOSSSSSSS | Variant of WV-3077. There was a randomer PS in WV-3077 | Exon 51 |
| WV-3116 | UCAAGGAAGAUGGCAUUUCU | 54 | fU*SfC*SfA*SfA*SmG:mG:fA*SmAmGmAmU:mGmG*SfC*SfA*SfU*SfU*SfU*SfC*SfU | 793 | SSSSDDSOOODOSSSSSSS | Variant of WV-3078. There was a randomer PS in WV-3078 | Exon 51 |
| WV-3117 | UCAAGGAAGAUGGCAUUUCU | 54 | fU*SfC*SfA*SfA*SfG:fG:fA*SfA*SmGmAmU:mG*SfG*SfC*SfA*SfU*SfU*SfU*SfC*SfU | 794 | SSSSDDSSOODSSSSSSSS | Variant of WV-3082. There was a randomer PS in WV-3082 | Exon 51 |
| WV-3118 | UCAAGGAAGAUGGCAUUUCU | 54 | fU*SfC*SfA*SfA*SmG:mG:fA*SfA*SmGmAmU:mG*SfG*SfC*SfA*SfU*SfU*SfU*SfC*SfU | 795 | SSSSDDSSOODSSSSSSSS | Variant of WV-3083. There was a randomer PS in WV-3083 | Exon 51 |
| WV-3120 | UCAAGGAAGAUGGCAUUUCU | 54 | fU*SfC*SfA*SfA*SfG*SfG*SfA*SfA*SfG*SmAmUmG*SfG*SfC*SfA*SfU*SfU*SfU*SfC*SfU | 796 | SSSSSSSSSOOSSSSSSSS | 9F-3OMe-8F 9Sp-2PO-8Sp | Exon 51 |
| WV-3121 | UCAAGGAAGAUGGCAUUUCU | 54 | fU*fC*fA*fA*fG*fG*fA*fA*fG*mAmUmG*fG*fC*fA*fU*fU*fU*fC*fU | 797 | XXXXXXXXXOOXXXXXXXX | 9F-3OMe-8F 9P5-2PO-8PS, randomer version of WV-3120 | Exon 51 |

TABLE 4-continued

| WAVE ID | Base Sequence | SEQ ID NO: | Description | SEQ ID NO: | Stereochemistry[1] | Notes | Target/Program |
|---|---|---|---|---|---|---|---|
| Example Oligonucleotides | | | | | | | |
| WV-3152 | UCAAGGAAGAUGGCAUUUCU | 54 | fU*SfC*SfA*SfA*SfG*SfG*SmAfA*SmGfA*SmUfG*SmGfC*SfA*SfU*SfU*SfU*SfC*SfU | 798 | SSSSSSOSOSOSOSSSSS | WV-2438 modifed | DMD |
| WV-3153 | UCAAGGAAGAUGGCAUUUCU | 54 | fU*SfC*SfA*SfA*SfG*SfG*SfA*SfA*SmGfA*SmUfG*SmG*SfC*SfA*SfU*SfU*SfU*SfC*SfU | 799 | SSSSSSSSOSOSSSSSSSS | WV-2529 modified | DMD |
| WV-3357 | UCAAGGAAGAUGGCAUUUCU | 54 | L001mU*mC*mA*mA*mG*mG*mA*mA*mG*mA*mU*mG*mG*mC*mA*mU*mU*mU*mC*mU | 800 | OXXXXXXXXXXXXXXXXXX | WV942 with C6 PO linker | Exon 51 |
| WV-3358 | UCAAGGAAGAUGGCAUUUCU | 54 | L001fU*SfC*SfA*SfA*SfG*SfG*SfA*SfA*SfG*SmAmU*SfG*SfG*SfC*SfA*SfU*SfU*SfU*SfC*SfU | 801 | OSSSSSSSSSOSSSSSSSSS | WV2531 with C6 PO linker | Exon 51 |
| WV-3359 | UCAAGGAAGAUGGCAUUUCU | 54 | Mod013L001mU*mC*mA*mA*mG*mG*mA*mA*mG*mA*mU*mG*mG*mC*mA*mU*mU*mU*mC*mU | 802 | OOXXXXXXXXXXXXXXXXXXX | WV942 with C6 amine PO linker, Lauric acid | Exon 51 |
| WV-3360 | UCAAGGAAGAUGGCAUUUCU | 54 | Mod013L001fU*SfC*SfA*SfA*SfG*SfG*SfA*SfA*SfG*SmAmU*SfG*SfG*SfC*SfA*SfU*SfU*SfU*SfC*SfU | 803 | OOSSSSSSSSOSSSSSSSSS | WV2531 with C6 amine PO linker, Lauric acid | Exon 51 |
| WV-3361 | UCAAGGAAGAUGGCAUUUCU | 54 | Mod014L001fU*SfC*SfA*SfA*SfG*SfG*SfA*SfA*SfG*SmAmU*SfG*SfG*SfC*SfA*SfU*SfU*SfU*SfC*SfU | 804 | OOSSSSSSSSOSSSSSSSSS | WV2531 with C6 amine PO linker, Myristic acid | Exon 51 |
| WV-3362 | UCAAGGAAGAUGGCAUUUCU | 54 | Mod005L001fU*SfC*SfA*SfA*SfG*SfG*SfA*SfA*SfG*SmAmU*SfG*SfG*SfC*SfA*SfU*SfU*SfU*SfC*SfU | 805 | OOSSSSSSSSOSSSSSSSSS | WV2531 with C6 amine PO linker, Palmitic acid | Exon 51 |
| WV-3363 | UCAAGGAAGAUGGCAUUUCU | 54 | Mod015L001fU*SfC*SfA*SfA*SfG*SfG*SfA*SfA*SfG*SmAmU*SfG*SfG*SfC*SfA*SfU*SfU*SfU*SfC*SfU | 806 | OOSSSSSSSSOSSSSSSSSS | WV2531 with C6 amine PO linker, Stearic acid | Exon 51 |
| WV-3364 | UCAAGGAAGAUGGCAUUUCU | 54 | Mod020L001fU*SfC*SfA*SfA*SfG*SfG*SfA*SfA*SfG*SmAmU*SfG*SfG*SfC*SfA*SfU*SfU*SfU*SfC*SfU | 807 | OOSSSSSSSSOSSSSSSSSS | WV2531 with C6 amine PO linker, Turbinaric acid | Exon 51 |
| WV-3365 | UCAAGGAAGAUGGCAUUUCU | 54 | Mod027L001fU*SfC*SfA*SfA*SfG*SfG*SfA*SfA*SfG*SmAmU*SfG*SfG*SfC*SfA*SfU*SfU*SfU*SfC*SfU | 808 | OSSSSSSSSSOSSSSSSSSS | WV2531 with C6 amine PO linker, MonoSulfonamide | Exon 51 |
| WV-3366 | UCAAGGAAGAUGGCAUUUCU | 54 | Mod029L001fU*SfC*SfA*SfA*SfG*SfG*SfA*SfA*SfG*SmAmU*SfG*SfG*SfC*SfA*SfU*SfU*SfU*SfC*SfU | 809 | OSSSSSSSSSOSSSSSSSSS | WV2531 with C6 amine PO linker, TriSulfonamide | Exon 51 |

TABLE 4-continued

| Example Oligonucleotides | | | | | | | |
|---|---|---|---|---|---|---|---|
| WAVE ID | Base Sequence | SEQ ID NO: | Description | SEQ ID NO: | Stereochemistry[1] | Notes | Target/Program |
| WV-3463 | UCAAGGAAGAUGGCAUUUCU | 54 | fU*SfC*SfA*SfA*SfG*SfGfA*SmAfG*SmAfU*SmGfGfC*SfA*SfU*SfU*SfU*SfC*SfU | 810 | SSSSSOSOSOSOOSSSSSS | modifying WV-3152, 2'f-U and Sp in the middle | Exon 51 |
| WV-3464 | UCAAGGAAGAUGGCAUUUCU | 54 | fU*SfC*SfA*SfA*SfG*SfG*SfA*SfAfG*SmAfU*SmG*SmG*SfC*SfA*SfU*SfU*SfU*SfC*SfU | 811 | SSSSSSSOSOSSSSSSSSS | modifying WV-3153, 2'f-U and Sp in the middle | Exon 51 |
| WV-3465 | UCAAGGAAGAUGGCAUUUCU | 54 | fU*SfC*SfA*SfA*SfG*SfG*SfA*SfA*SfG*SmAfU*SmG*SfG*SfC*SfA*SfU*SfU*SfU*SfC*SfU | 812 | SSSSSSSSSOSSSSSSSSS | modifying WV-2531, 2'f-U and Sp in the middle | Exon 51 |
| WV-3466 | UCAAGGAAGAUGGCAUUUCU | 54 | fU*SfC*SfA*SfA*SfG*SfG*SfA*SfA*SmGmAfU*SmGmG*SfC*SfA*SfU*SfU*SfU*SfC*SfU | 813 | SSSSSSSSOOSOSSSSSS | modifying WV-3028, 2'f-U and Sp in the middle | Exon 51 |
| WV-3467 | UCAAGGAAGAUGGCAUUUCU | 54 | fU*SfC*SfA*SfA*SfG*SfG*SfA*SfA*SfG*SmAfU*SmGfG*SfC*SfA*SfU*SfU*SfU*SfC*SfU | 814 | SSSSSSSSSOSOSSSSSSS | modifying WV-3120, 2'f-U and Sp in the middle | Exon 51 |
| WV-3468 | UCAAGGAAGAUGGCAUUUCU | 54 | fU*SfC*SfA*SfA*SfG*SfG*mAmAmGmAfU*SmGmG*SfC*SfA*SfU*SfU*SfU*SfC*SfU | 815 | SSSSSXOOOOSOSSSSSS | modifying WV-3046, 2'f-U and Sp in the middle | Exon 51 |
| WV-3469 | UCAAGGAAGAUGGCAUUUCU | 54 | fU*SfC*SfA*SfA*SfG*SfG*SmA*SmA*SmG*SmA*SfU*SmG*SmG*SfC*SfA*SfU*SfU*SfU*SfC*SfU | 816 | SSSSSSSSSSSSSSSSSS | modifying WV-3047, 2'f-U and Sp in the middle | Exon 51 |
| WV-3470 | UCAAGGAAGAUGGCAUUUCU | 54 | fU*SfC*SfA*SfA*SfG*SfG*SmAfA*SmGfA*SfUfG*SmGfC*SfA*SfU*SfU*SfU*SfC*SfU | 817 | SSSSSSOSOSOSOSSSSSS | 2'F on the middle U; modified on WV-3152 | DMD |
| WV-3471 | UCAAGGAAGAUGGCAUUUCU | 54 | fU*SfC*SfA*SfA*SfG*SfG*SmAfA*SmGfA*SfUmGmGfC*SfA*SfU*SfU*SfU*SfC*SfU | 818 | SSSSSSOSOSOOOSSSSSS | 2'F on the middle U; modified on WV-3152 | DMD |
| WV-3472 | UCAAGGAAGAUGGCAUUUCU | 54 | fU*SfC*SfA*SfA*SfG*SfG*SmAfA*SmGfA*SfU*SmGmGfC*SfA*SfU*SfU*SfU*SfC*SfU | 819 | SSSSSSOSOSSOOSSSSSS | 2'F on the middle U; modified on WV-3152 | DMD |
| WV-3473 | UCAAGGAAGAUGGCAUUUCU | 54 | fU*SfC*SfA*SfA*SfG*SfG*SmAfA*SmGmA*SfU*SmGmGfC*SfA*SfU*SfU*SfU*SfC*SfU | 820 | SSSSSSOSOSSOOSSSSSS | 2'F on the middle U; modified on WV-3152 | DMD |
| WV-3506 | UCAAGGAAGAUGGCAUUUCU | 54 | fU*SfC*SfA*SfA*SfG*SfG*SmAfA*SmGfAfU*SmGmGfC*SfA*SfU*SfU*SfU*SfC*SfU | 821 | SSSSSSOSOOSOOSSSSSS | modifed on WV-3472; except for PO linker between fA (10th nt) and fU (11th nt) | Exon 51 |

TABLE 4-continued

| Example Oligonucleotides | | | | | | | |
|---|---|---|---|---|---|---|---|
| WAVE ID | Base Sequence | SEQ ID NO: | Description | SEQ ID NO: | Stereochemistry[1] | Notes | Target/Program |
| WV-3507 | UCAAGGAAGAUGGCAUUUCU | 54 | fU*SfC*SfA*SfA*SfG*SfG*SmAfA*SmGmAfU*SmGmGfC*SfA*SfU*SfU*SfU*SfC*SfU | 822 | SSSSSSOSOOSOOSSSSS | modifed on WV-3473; except for PO linker between mA (10th nt) and fU (11th nt) | Exon 51 |
| WV-3508 | UCAAGGAAGAUGGCAUUUCU | 54 | fU*SfC*SfA*SfA*SfG*SfG*SmAfA*SmGfA*SfU*SmGmGfC*SfAfU*SfU*SfU*SfC*SfU | 823 | SSSSSSOSOSSOOSOSSSS | modifed on WV-3472; except for PO linker between fA (15th nt) and fU (16th nt) | Exon 51 |
| WV-3509 | UCAAGGAAGAUGGCAUUUCU | 54 | fU*SfC*SfA*SfA*SfG*SfG*SmAfA*SmGmA*SfU*SmGmGfC*SfAfU*SfU*SfU*SfC*SfU | 824 | SSSSSSOSOSSOOSOSSSS | modifed on WV-3473; except for PO linker between fA (15th nt) and fU (16th nt) | Exon 51 |
| WV-3510 | UCAAGGAAGAUGGCAUUUCU | 54 | fU*SfC*SfA*SfA*SfG*SfG*SmAfA*SmGfAfU*SmGmGfC*SmA*SfU*SfU*SfU*SfC*SfU | 825 | SSSSSSOSOOSOOSSSSS | modifed on WV-3472; except for mA on 15th nt | Exon 51 |
| WV-3511 | UCAAGGAAGAUGGCAUUUCU | 54 | fU*SfC*SfA*SfA*SfG*SfG*SmAfA*SmGmAfU*SmGmGfC*SmA*SfU*SfU*SfU*SfC*SfU | 826 | SSSSSSOSOOSOOSSSSS | modifed on WV-3473; except for mA on 15th nt | Exon 51 |
| WV-3512 | UCAAGGAAGAUGGCAUUUCU | 54 | fU*SfC*SfA*SfA*SfG*SfG*SmAfA*SmGfAfU*SmGmGfC*SmAfU*SfU*SfU*SfC*SfU | 827 | SSSSSSOSOOSOOSOSSSS | modifed on WV-3472; except for PO linker between fA (10th nt) and fU (11th nt); mA on 15th nt, and PO between mA (15th nt) and fU (16th nt) | Exon 51 |
| WV-3513 | UCAAGGAAGAUGGCAUUUCU | 54 | fU*SfC*SfA*SfA*SfG*SfG*SmAfA*SmGmAfU*SmGmGfC*SmAfU*SfU*SfU*SfC*SfU | 828 | SSSSSSOSOOSOOSOSSSS | modifed on WV-3472; except for PO linker between mA (10th nt) and fU (11th nt); mA on 15th nt, and PO between mA (15th nt) and fU (16th nt) | Exon 51 |
| WV-3514 | UCAAGGAAGAUGGCAUUUCU | 54 | fU*SfC*SfA*SfA*SfG*SfG*SmAfA*SmGfAfU*SmGmGfC*SfAfU*SfU*SfU*SfC*SfU | 829 | SSSSSSOSOOSOOSOSSSS | modifed on WV-3472; except for PO linker between fA (10th nt) and fU (11th nt); PO between fA (15th nt) and fU (16th nt) | Exon 51 |

TABLE 4-continued

| Example Oligonucleotides | | | | | | | |
|---|---|---|---|---|---|---|---|
| WAVE ID | Base Sequence | SEQ ID NO: | Description | SEQ ID NO: | Stereochemistry[1] | Notes | Target/Program |
| WV-3515 | UCAAGGA AGAUGGC AUUUCU | 54 | fU*SfC*SfA*SfA*SfG*SfG*SmAfA*SmG mAfU*SmGmGfC*SfAfU*SfU*SfU*SfC* SfU | 830 | SSSSSSOSO OSOOSOSSSS | modifed on WV-3472; except for PO linker between mA (10th nt) and fU (11th nt); PO between fA (15th nt) and fU (16th nt) | Exon 51 |
| WV-3516 | UCAAGGA AGAUGGC AUUUCU | 54 | fU*fC*fA*fA*fG*fG*mAfA*mGfA*mUf G*mGfC*fA*fU*fU*fU*fC*fU | 831 | XXXXXXO XOXOXOX XXXXX | randomer version of WV-3152 | Exon 51 |
| WV-3517 | UCAAGGA AGAUGGC AUUUCU | 54 | Mod030fU*fC*fA*fA*fG*fG*mAfA*mGf A*mUfG*mGfC*fA*fU*fU*fU*fC*fU | 832 | OXXXXXX OXOXOXO XXXXXX | with PO linker, Lauric | Exon 51 |
| WV-3518 | UCAAGGA AGAUGGC AUUUCU | 54 | Mod031fU*fC*fA*fA*fG*fG*mAfA*mGf A*mUfG*mGfC*fA*fU*fU*fU*fC*fU | 833 | OXXXXXX OXOXOXO XXXXXX | with PO linker, Myristic | Exon 51 |
| WV-3519 | UCAAGGA AGAUGGC AUUUCU | 54 | Mod032fU*fC*fA*fA*fG*fG*mAfA*mGf A*mUfG*mGfC*fA*fU*fU*fU*fC*fU | 834 | OXXXXXX OXOXOXO XXXXXX | with PO linker, Palmitic | Exon 51 |
| WV-3520 | UCAAGGA AGAUGGC AUUUCU | 54 | Mod033fU*fC*fA*fA*fG*fG*mAfA*mGf A*mUfG*mGfC*fA*fU*fU*fU*fC*fU | 835 | OXXXXXX OXOXOXO XXXXXX | with PO linker, Stearic | Exon 51 |
| WV-3543 | UCAAGGA AGAUGGC AUUUCU | 54 | Mod013L001fU*SfC*SfA*SfA*SfG*SfG* SmAfA*SmGmA*SfU*SmGmGfC*SfA*S fU*SfU*SfU*SfC*SfU | 836 | OOSSSSSSO SOSSOOSSS SSS | WV-3473, Lauric acid, C6 PO linker | Exon 51 |
| WV-3544 | UCAAGGA AGAUGGC AUUUCU | 54 | Mod005L001fU*SfC*SfA*SfA*SfG*SfG* SmAfA*SmGmA*SfU*SmGmGfC*SfA*S fU*SfU*SfU*SfC*SfU | 837 | OOSSSSSSO SOSSOOSSS SSS | WV-3473, Palmitic acid, C6 PO linker | Exon 51 |
| WV-3545 | UCAAGGA AGAUGGC AUUUCU | 54 | Mod015L001fU*SfC*SfA*SfA*SfG*SfG* SmAfA*SmGmA*SfU*SmGmGfC*SfA*S fU*SfU*SfU*SfC*SfU | 838 | OOSSSSSSO SOSSOOSSS SSS | WV-3473, Stearic acid, C6 PO linker | Exon 51 |
| WV-3546 | UCAAGGA AGAUGGC AUUUCU | 54 | Mod020L001fU*SfC*SfA*SfA*SfG*SfG* SmAfA*SmGmA*SfU*SmGmGfC*SfA*S fU*SfU*SfU*SfC*SfU | 839 | OOSSSSSSO SOSSOOSSS SSS | WV-3473, Turbinaric acid, C6 PO linker | Exon 51 |
| WV-3547 | UCAAGGA AGAUGGC AUUUCU | 54 | Mod027L001fU*SfC*SfA*SfA*SfG*SfG* SmAfA*SmGmA*SfU*SmGmGfC*SfA*S fU*SfU*SfU*SfC*SfU | 840 | OSSSSSSOS OSSOOSSSS SS | WV-3473, Monosulfonamide, C6 PO linker | Exon 51 |

TABLE 4-continued

| Example Oligonucleotides | | | | | | | |
|---|---|---|---|---|---|---|---|
| WAVE ID | Base Sequence | SEQ ID NO: | Description | SEQ ID NO: | Stereochemistry[1] | Notes | Target/Program |
| WV-3548 | UCAAGGAAGAUGGCAUUUCU | 54 | Mod029L001fU*SfC*SfA*SfA*SfG*SfG*SmAfA*SmGmA*SfU*SmGmGfC*SfA*SfU*SfU*SfU*SfC*SfU | 841 | OSSSSSSOSOSSOOSSSSSS | WV-3473, Trisulfonamide, C6 PO linker | Exon 51 |
| WV-3549 | UCAAGGAAGAUGGCAUUUCU | 54 | Mod030fU*SfC*SfA*SfA*SfG*SfG*SmAfA*SmGmA*SfU*SmGmGfC*SfA*SfU*SfU*SfU*SfC*SfU | 842 | OSSSSSSOSOSSOOSSSSSS | WV-3473, Lauric, PO linker | Exon 51 |
| WV-3550 | UCAAGGAAGAUGGCAUUUCU | 54 | Mod032fU*SfC*SfA*SfA*SfG*SfG*SmAfA*SmGmA*SfU*SmGmGfC*SfA*SfU*SfU*SfU*SfC*SfU | 843 | OSSSSSSOSOSSOOSSSSSS | WV-3473, Palmitic, PO linker | Exon 51 |
| WV-3551 | UCAAGGAAGAUGGCAUUUCU | 54 | Mod033fU*SfC*SfA*SfA*SfG*SfG*SmAfA*SmGmA*SfU*SmGmGfC*SfA*SfU*SfU*SfU*SfC*SfU | 844 | OSSSSSSOSOSSOOSSSSSS | WV-3473, Stearic, PO linker | Exon 51 |
| WV-3552 | UCAAGGAAGAUGGCAUUUCU | 54 | Mod020L001*fU*SfC*SfA*SfA*SfG*SfG*SmAfA*SmGmA*SfU*SmGmGfC*SfA*SfU*SfU*SfU*SfC*SfU | 845 | OXSSSSSSOSOSSOOSSSSSS | WV-3473, Turbinaric acid, C6 PS linker | Exon 51 |
| WV-3553 | UCAAGGAAGAUGGCAUUUCU | 54 | Mod005L001*fU*SfC*SfA*SfA*SfG*SfG*SmAfA*SmGmA*SfU*SmGmGfC*SfA*SfU*SfU*SfU*SfC*SfU | 846 | OXSSSSSSOSOSSOOSSSSSS | WV-3473, Palmitic acid, C6 PS linker | Exon 51 |
| WV-3554 | UCAAGGAAGAUGGCAUUUCU | 54 | Mod014L001fU*SfC*SfA*SfA*SfG*SfG*SmAfA*SmGmA*SfU*SmGmGfC*SfA*SfU*SfU*SfU*SfC*SfU | 847 | OOSSSSSSOSOSSOOSSSSSS | WV-3473, Myristic acid, C6 PO linker | Exon 51 |
| WV-3555 | UCAAGGAAGAUGGCAUUUCU | 54 | Mod030*fU*SfC*SfA*SfA*SfG*SfG*SmAfA*SmGmA*SfU*SmGmGfC*SfA*SfU*SfU*SfU*SfC*SfU | 848 | XSSSSSSOSOSSOOSSSSSS | WV-3473, Lauric PS linker | Exon 51 |
| WV-3556 | UCAAGGAAGAUGGCAUUUCU | 54 | Mod032*fU*SfC*SfA*SfA*SfG*SfG*SmAfA*SmGmA*SfU*SmGmGfC*SfA*SfU*SfU*SfU*SfC*SfU | 849 | XSSSSSSOSOSSOOSSSSSS | WV-3473, Palmitic PS linker | Exon 51 |
| WV-3557 | UCAAGGAAGAUGGCAUUUCU | 54 | Mod033*fU*SfC*SfA*SfA*SfG*SfG*SmAfA*SmGmA*SfU*SmGmGfC*SfA*SfU*SfU*SfU*SfC*SfU | 850 | XSSSSSSOSOSSOOSSSSSS | WV-3473, Stearic PS linker | Exon 51 |
| WV-3558 | UCAAGGAAGAUGGCAUUUCU | 54 | Mod033*fU*fC*fA*fA*fG*fG*mAfA*mGfA*mUfG*mGfC*fA*fU*fU*fU*fC*fU | 851 | XXXXXXXOXOXOXOXXXXXX | with PS linker, Stearic linker | Exon 51 |
| WV-3559 | UCAAGGAAGAUGGCAUUUCU | 54 | Mod020L001fU*fC*fA*fA*fG*fG*mAfA*mGfA*mUfG*mGfC*fA*fU*fU*fU*fC*fU | 852 | OOXXXXXXOXOXOXOXXXXXX | with C6 amine PO linker, Turbinaric acid | Exon 51 |

TABLE 4-continued

| Example Oligonucleotides | | | | | | | |
|---|---|---|---|---|---|---|---|
| WAVE ID | Base Sequence | SEQ ID NO: | Description | SEQ ID NO: | Stereochemistry[1] | Notes | Target/Program |
| WV-3560 | UCAAGGAAGAUGGCAUUUCU | 54 | Mod020L001*fU*fC*fA*fA*fG*fG*mAfA*mGfA*mUfG*mGfC*fA*fU*fU*fU*fC*fU | 853 | OXXXXXXXOXOXOXOXXXXXX | with C6 amine PS linker, Turbinaric acid | Exon 51 |
| WV-3753 | UCAAGGAAGAUGGCAUUUCU | 54 | L001*fU*SfC*SfA*SfA*SfG*SfG*SmAfA*SmGmA*SfU*SmGmGfC*SfA*SfU*SfU*SfU*SfC*SfU | 854 | XSSSSSSOSOSSOOSSSSSS | WV-3473, C6 PS linker | Exon 51 |
| WV-3754 | UCAAGGAAGAUGGCAUUUCU | 54 | L001*fU*SfC*SfA*SfA*SfG*SfG*SmAfA*SmGmA*SfU*SmGmGfC*SfA*SfU*SfU*SfU*SfC*SfU | 855 | OSSSSSSOSOSSOOSSSSSS | WV-3473, C6 PO linker | Exon 51 |
| WV-3812 | GCCAACUGGGAGCUGGAGCGCACCAACCAG | 259 | rGrCrCrArArCrUrGrGrGrArGrCrUrGrGrArGrCrGrCrArCrCrArArCrCrArG | 856 | OOOOOOOOOOOOOOOOOOOOOOOOOOOOO | Complementary RNA | MSTN |
| WV-3820 | UCAAGGAAGAUGGCAUUUCU | 54 | L001*fU*fC*fA*fA*fG*fG*mAfA*mGfA*mUfG*mGfC*fA*fU*fU*fU*fC*fU | 857 | XXXXXXXOXOXOXOXXXXXX | WV-3516, C6 PS linker | Exon 51 |
| WV-3821 | UCAAGGAAGAUGGCAUUUCU | 54 | L001fU*fC*fA*fA*fG*fG*mAfA*mGfA*mUfG*mGfC*fA*fU*fU*fU*fC*fU | 858 | OXXXXXXOXOXOXOXXXXXX | WV-3516, C6 PO linker | Exon 51 |
| WV-3855 | UCAAGGAAGAUGGCAUUUCU | 54 | Mod015L001*fU*fC*fA*fA*fG*fG*mAfA*mGfA*mUfG*mGfC*fA*fU*fU*fU*fC*fU | 859 | OXXXXXXXOXOXOXOXXXXXX | WV-3516, C6 PS linker, Stearic acid | Exon 51 |
| WV-3856 | UCAAGGAAGAUGGCAUUUCU | 54 | Mod015L001fU*fC*fA*fA*fG*fG*mAfA*mGfA*mUfG*mGfC*fA*fU*fU*fU*fC*fU | 860 | OOXXXXXXOXOXOXOXXXXXX | WV-3516, C6 PO linker, Stearic acid | Exon 51 |
| WV-3975 | CCUUCCCUGAAGGUUCCUCC | 260 | fC*fC*fU*fU*fC*fC*mCfU*GmAfA*mGmGfU*fU*fC*fC*fU*fC*fC | 862 | XXXXXXOXOOXOOXXXXXX | Negative control | NA |
| WV-3976 | CCUUCCCUGAAGGUUCCUCC | 260 | L001fC*fC*fU*fU*fC*fC*mCfU*GmAfA*mGmGfU*fU*fC*fC*fU*fC*fC | 863 | OXXXXXXOXOOXOOXXXXXX | Negative control | NA |
| WV-3977 | CCUUCCCUGAAGGUUCCUCC | 260 | Mod020L001fC*fC*fU*fU*fC*fC*mCfU*GmAfA*mGmGfU*fU*fC*fC*fU*fC*fC | 864 | OOXXXXXXOXOOXOOXXXXXX | Negative control | NA |
| WV-3978 | CCUUCCCUGAAGGUUCCUCC | 260 | fC*fC*fU*fU*fC*fC*mCfU*mGmAfA*mGmGfU*fU*fC*fC*fU*fC*fC | 865 | XXXXXXOXOOXOOXXXXXX | Negative control | NA |

TABLE 4-continued

| Example Oligonucleotides | | | | | | | |
|---|---|---|---|---|---|---|---|
| WAVE ID | Base Sequence | SEQ ID NO: | Description | SEQ ID NO: | Stereochemistry[1] | Notes | Target/Program |
| WV-3979 | CCUUCCCUGAAGGUUCCUCC | 260 | L001fC*fC*fU*fU*fC*fC*mCfU*mGmAfA*mGmGfU*fU*fC*fC*fU*fC*fC | 866 | OXXXXXXOXOOXOOXXXXXX | Negative control | NA |
| WV-3980 | CCUUCCCUGAAGGUUCCUCC | 260 | Mod020L001fC*fC*fU*fU*fC*fC*mCfU*mGmAfA*mGmGfU*fU*fC*fC*fU*fC*fC | 867 | OOXXXXXXOXOOXOOXXXXXX | Negative control | NA |
| WV-4106 | UCAAGGAAGAUGGCAUUUCU | 54 | Mod015L001*fU*SfC*SfA*SfA*SfG*SfG*SmAfA*SmGmA*SfU*SmGmGfC*SfA*SfU*SfU*SfU*SfC*SfU | 868 | OXSSSSSSOSOSSOOSSSSSS | WV-3473, C6 PS linker, Stearic acid | Exon 51 |
| WV-4107 | UCAAGGAAGAUGGCAUUUCU | 54 | Mod015L001*SfU*SfC*SfA*SfA*SfG*SfG*SmAfA*SmGmA*SfU*SmGmGfC*SfA*SfU*SfU*SfU*SfC*SfU | 869 | OSSSSSSSOSOSSOOSSSSSS | WV-3473, Sp stereopure C6 linker, stearic acid | DMD |
| WV-4191 | UCAAGGAAGAUGGCAUUUCU | 54 | L001 * SfU * SfC * SfA * SfA * SfG * SfG * SmAfA * SmGmA * SfU * SmGmGfC * SfA * SfU * SfU * SfU * SfC * SfU | 1230 | SSSSSSSOSOSSOOSSSSSS | WV-3473, C6 and Sp stereopure linker | DMD |
| WV-4231 | UCAAGGAAGAUGGCAUUUC | 1123 | fU*SfC*SfA*SfA*SfG*SfG*SmAfA*SmGmA*SfU*SmGmGfC*SfA*SfU*SfU*SfU*SfC | 1231 | SSSSSSOSOSSOOSSS | WV-3473 based, n-1 on 3' SS | DMD |
| WV-4232 | UCAAGGAAGAUGGCAUUU | 1124 | fU*SfC*SfA*SfA*SfG*SfG*SmAfA*SmGmA*SfU*SmGmGfC*SfA*SfU*SfU*SfU | 1232 | SSSSSSOSOSSOOSSSS | WV-3473 based, n-2 on 3' | DMD |
| WV-4233 | CAAGGAAGAUGGCAUUUCU | 1125 | fC*SfA*SfA*SfG*SfG*SmAfA*SmGmA*SfU*SmGmGfC*SfA*SfU*SfU*SfU*SfC*SfU | 1233 | SSSSSOSOSSOOSSSSSS | WV-3473 based, n-1 on 5' | DMD |
| WV-4610 | GGCCAAACCUCGGCUUACCU | 1126 | Mod020L001mG*mG*mC*mC*mA*mA*mA*mC*mC*mU*mC*mG*mG*mC*mU*mU*mA*mC*mC*mU | 1234 | OOXXXXXXXXXXXXXXXXXXX | WV-943, C6 linker and PO, Turbinaric acid | DMD mouse Exon23 |
| WV-4611 | GGCCAAACCUCGGCUUACCU | 1126 | Mod015L001mG*mG*mC*mC*mA*mA*mA*mC*mC*mU*mC*mG*mG*mC*mU*mU*mA*mC*mC*mU | 1235 | OOXXXXXXXXXXXXXXXXXXX | WV-943, C6 linker and PO, Stearic acid | DMD mouse Exon23 |
| WV-4614 | UUCUGUAAGGUUUUUAUGUG | 1127 | fU*fU*fC*fU*fG*fU*mA*mA*mG*mG*mU*mU*mU*mU*fU*fA*fU*fG*fU*fG | 1236 | XXXXXXXXXXXXXXXXXXX | DMD mouse Exon23 | DMD |

TABLE 4-continued

Example Oligonucleotides

| WAVE ID | Base Sequence | SEQ ID NO: | Description | SEQ ID NO: | Stereochemistry[1] | Notes | Target/Program |
|---|---|---|---|---|---|---|---|
| WV-4615 | AUUUCUGUAAGGUUUUUAUG | 1128 | fA*fU*fU*fU*fC*fU*mG*mU*mA*mA*mG*mG*mU*mU*fU*fU*fU*fA*fU*fG | 1237 | XXXXXXXXXXXXXXXXXXX | DMD mouse Exon23 | DMD |
| WV-4616 | CCAUUUCUGUAAGGUUUUUA | 1129 | fC*fC*fA*fU*fU*fU*mC*mU*mG*mU*mA*mA*mG*mG*fU*fU*fU*fU*fU*fA | 1238 | XXXXXXXXXXXXXXXXXXX | DMD mouse Exon23 | DMD |
| WV-4617 | AUCCAUUUCUGUAAGGUUUU | 1130 | fA*fU*fC*fC*fA*fU*mU*mU*mC*mU*mG*mU*mA*mA*fG*fG*fU*fU*fU*fU | 1239 | XXXXXXXXXXXXXXXXXXX | DMD mouse Exon23 | DMD |
| WV-4618 | CAUCCAUUUCUGUAAGGUUU | 1131 | fC*fA*fU*fC*fC*fA*mU*mU*mU*mC*mU*mG*mU*mA*fA*fG*fG*fU*fU*fU | 1240 | XXXXXXXXXXXXXXXXXXX | DMD mouse Exon23 | DMD |
| WV-4619 | CCAUCCAUUUCUGUAAGGUU | 1132 | fC*fC*fA*fU*fC*fC*mA*mU*mU*mU*mC*mU*mG*mU*fA*fA*fG*fG*fU*fU | 1241 | XXXXXXXXXXXXXXXXXXX | DMD mouse Exon23 | DMD |
| WV-4620 | GCCAUCCAUUUCUGUAAGGU | 1133 | fG*fC*fC*fA*fU*fC*mC*mA*mU*mU*mU*mC*mU*mG*fU*fA*fA*fG*fG*fU | 1242 | XXXXXXXXXXXXXXXXXXX | DMD mouse Exon23 | DMD |
| WV-4621 | AGCCAUCCAUUUCUGUAAGG | 1134 | fA*fG*fC*fC*fA*fU*mC*mC*mA*mU*mU*mU*mC*mU*fG*fU*fA*fA*fG*fG | 1243 | XXXXXXXXXXXXXXXXXXX | DMD mouse Exon23 | DMD |
| WV-4622 | CAGCCAUCCAUUUCUGUAAG | 1135 | fC*fA*fG*fC*fC*fA*mU*mC*mC*mA*mU*mU*mU*mC*fU*fG*fU*fA*fA*fG | 1244 | XXXXXXXXXXXXXXXXXXX | DMD mouse Exon23 | DMD |
| WV-4623 | UCAGCCAUCCAUUUCUGUAA | 1136 | fU*fC*fA*fG*fC*fC*mA*mU*mC*mC*mA*mU*mU*mU*fC*fU*fG*fU*fA*fA | 1245 | XXXXXXXXXXXXXXXXXXX | DMD mouse Exon23 | DMD |
| WV-4624 | UUCAGCCAUCCAUUUCUGUA | 1137 | fU*fU*fC*fA*fG*fC*mC*mA*mU*mC*mC*mA*mU*mU*fU*fC*fU*fG*fU*fA | 1246 | XXXXXXXXXXXXXXXXXXX | DMD mouse Exon23 | DMD |

TABLE 4-continued

| Example Oligonucleotides | | | | | | | |
|---|---|---|---|---|---|---|---|
| WAVE ID | Base Sequence | SEQ ID NO: | Description | SEQ ID NO: | Stereochemistry[1] | Notes | Target/Program |
| WV-4625 | CUUCAGCCAUCCAUUUCUGU | 1138 | fC*fU*fU*fC*fA*fG*mC*mC*mA*mU*mC*mC*mA*mU*fU*fU*fC*fU*fG*fU | 1247 | XXXXXXXXXXXXXXXXXXX | DMD mouse Exon23 | DMD |
| WV-4626 | ACUUCAGCCAUCCAUUUCUG | 1139 | fA*fC*fU*fU*fC*fA*mG*mC*mC*mA*mU*mC*mC*mA*fU*fU*fU*fC*fU*fG | 1248 | XXXXXXXXXXXXXXXXXXX | DMD mouse Exon23 | DMD |
| WV-4627 | AACUUCAGCCAUCCAUUUCU | 1140 | fA*fA*fC*fU*fU*fC*mA*mG*mC*mC*mA*mU*mC*mC*fA*fU*fU*fU*fC*fU | 1249 | XXXXXXXXXXXXXXXXXXX | DMD mouse Exon23 | DMD |
| WV-4628 | CAACUUCAGCCAUCCAUUUC | 1141 | fC*fA*fA*fC*fU*fU*mC*mA*mG*mC*mC*mA*mU*mC*fC*fA*fU*fU*fU*fC | 1250 | XXXXXXXXXXXXXXXXXXX | DMD mouse Exon23 | DMD |
| WV-4629 | UCAACUUCAGCCAUCCAUUU | 1142 | fU*fC*fA*fA*fC*fU*mU*mC*mA*mG*mC*mC*mA*mU*fC*fC*fA*fU*fU*fU | 1251 | XXXXXXXXXXXXXXXXXXX | DMD mouse Exon23 | DMD |
| WV-4630 | AUCAACUUCAGCCAUCCAUU | 1143 | fA*fU*fC*fA*fA*fC*mU*mU*mC*mA*mG*mC*mC*mA*fU*fC*fC*fA*fU*fU | 1252 | XXXXXXXXXXXXXXXXXXX | DMD mouse Exon23 | DMD |
| WV-4631 | CAUCAACUUCAGCCAUCCAU | 1144 | fC*fA*fU*fC*fA*fA*mC*mU*mU*mC*mA*mG*mC*mC*fA*fU*fC*fC*fA*fU | 1253 | XXXXXXXXXXXXXXXXXXX | DMD mouse Exon23 | DMD |
| WV-4632 | ACAUCAACUUCAGCCAUCCA | 1145 | fA*fC*fA*fU*fC*fA*mA*mC*mU*mU*mC*mA*mG*mC*fC*fA*fU*fC*fC*fA | 1254 | XXXXXXXXXXXXXXXXXXX | DMD mouse Exon23 | DMD |
| WV-4633 | AACAUCAACUUCAGCCAUCC | 1146 | fA*fA*fC*fA*fU*fC*mA*mA*mC*mU*mU*mC*mA*mG*fC*fC*fA*fU*fC*fC | 1255 | XXXXXXXXXXXXXXXXXXX | DMD mouse Exon23 | DMD |

TABLE 4-continued

Example Oligonucleotides

| WAVE ID | Base Sequence | SEQ ID NO: | Description | SEQ ID NO: | Stereochemistry[1] | Notes | Target/Program |
|---|---|---|---|---|---|---|---|
| WV-4634 | GAAAACAUCAACUUCAGCCA | 1147 | fG*fA*fA*fA*fA*fC*mA*mU*mC*mA*mA*mC*mU*mU*fC*fA*fG*fC*fC*fA | 1256 | XXXXXXXXXXXXXXXXXXX | DMD mouse Exon23 | DMD |
| WV-4635 | CAGGAAAACAUCAACUUCAG | 1148 | fC*fA*fG*fG*fA*fA*mA*mA*mC*mA*mU*mC*mA*mA*fC*fU*fU*fC*fA*fG | 1257 | XXXXXXXXXXXXXXXXXXX | DMD mouse Exon23 | DMD |
| WV-4636 | UUUCAGGAAAACAUCAACUU | 1149 | fU*fU*fU*fC*fA*fG*mG*mA*mA*mA*mA*mC*mA*mU*fC*fA*fA*fC*fU*fU | 1258 | XXXXXXXXXXXXXXXXXXX | DMD mouse Exon23 | DMD |
| WV-4637 | CUCUUUCAGGAAAACAUCAA | 1150 | fC*fU*fC*fU*fU*fU*mC*mA*mG*mG*mA*mA*mA*mA*fC*fA*fU*fC*fA*fA | 1259 | XXXXXXXXXXXXXXXXXXX | DMD mouse Exon23 | DMD |
| WV-4638 | UUCCUCUUUCAGGAAAACAU | 1151 | fU*fU*fC*fC*fU*fC*mU*mU*mU*mC*mA*mG*mG*mA*fA*fA*fA*fC*fA*fU | 1260 | XXXXXXXXXXXXXXXXXXX | DMD mouse Exon23 | DMD |
| WV-4639 | GCCAUUCCUCUUUCAGGAAA | 1152 | fG*fC*fC*fA*fU*fU*mC*mC*mU*mC*mU*mU*mU*mC*fA*fG*fG*fA*fA*fA | 1261 | XXXXXXXXXXXXXXXXXXX | DMD mouse Exon23 | DMD |
| WV-4640 | GGCCAUUCCUCUUUCAGGAA | 1153 | fG*fG*fC*fC*fA*fU*mU*mC*mC*mU*mC*mU*mU*mU*fC*fA*fG*fG*fA*fA | 1262 | XXXXXXXXXXXXXXXXXXX | DMD mouse Exon23 | DMD |
| WV-4641 | AGGCCAUUCCUCUUUCAGGA | 1154 | fA*fG*fG*fC*fC*fA*mU*mU*mC*mC*mU*mC*mU*mU*fU*fC*fA*fG*fG*fA | 1263 | XXXXXXXXXXXXXXXXXXX | DMD mouse Exon23 | DMD |
| WV-4642 | CAGGCCAUUCCUCUUUCAGG | 1155 | fC*fA*fG*fG*fC*fC*mA*mU*mU*mC*mC*mU*mC*mU*fU*fU*fC*fA*fG*fG | 1264 | XXXXXXXXXXXXXXXXXXX | DMD mouse Exon23 | DMD |

TABLE 4-continued

| Example Oligonucleotides | | | | | | | |
|---|---|---|---|---|---|---|---|
| WAVE ID | Base Sequence | SEQ ID NO: | Description | SEQ ID NO: | Stereochemistry[1] | Notes | Target/Program |
| WV-4643 | GCAGGCCAUUCCUCUUUCAG | 1156 | fG*fC*fA*fG*fG*fC*mC*mA*mU*mU*mC*mC*mU*mC*fU*fU*fU*fC*fA*fG | 1265 | XXXXXXXXXXXXXXXXXXX | DMD mouse Exon23 | DMD |
| WV-4644 | GGCAGGCCAUUCCUCUUUCA | 1157 | fG*fG*fC*fA*fG*fG*mC*mC*mA*mU*mU*mC*mC*mU*fC*fU*fU*fU*fC*fA | 1266 | XXXXXXXXXXXXXXXXXXX | DMD mouse Exon23 | DMD |
| WV-4645 | GGGCAGGCCAUUCCUCUUUC | 1158 | fG*fG*fG*fC*fA*fG*mG*mC*mC*mA*mU*mU*mC*mC*fU*fC*fU*fU*fU*fC | 1267 | XXXXXXXXXXXXXXXXXXX | DMD mouse Exon23 | DMD |
| WV-4646 | AGGGCAGGCCAUUCCUCUUU | 1159 | fA*fG*fG*fG*fC*fA*mG*mG*mC*mC*mA*mU*mU*mC*fC*fU*fC*fUqU*fU | 1268 | XXXXXXXXXXXXXXXXXXX | DMD mouse Exon23 | DMD |
| WV-4647 | CAGGGCAGGCCAUUCCUCUU | 1160 | fC*fA*fG*fG*fG*fC*mA*mG*mG*mC*mC*mA*mU*mU*fC*fC*fU*fC*fU*fU | 1269 | XXXXXXXXXXXXXXXXXXX | DMD mouse Exon23 | DMD |
| WV-4648 | CCAGGGCAGGCCAUUCCUCU | 1161 | fC*fC*fA*fG*fG*fG*mC*mA*mG*mG*mC*mC*mA*mU*fU*fC*fC*fU*fC*fU | 1270 | XXXXXXXXXXXXXXXXXXX | DMD mouse Exon23 | DMD |
| WV-4649 | CCCAGGGCAGGCCAUUCCUC | 1162 | fC*fC*fC*fA*fG*fG*mG*mC*mA*mG*mG*mC*mC*mA*fU*fU*fC*fC*fU*fC | 1271 | XXXXXXXXXXXXXXXXXXX | DMD mouse Exon23 | DMD |
| WV-4650 | CCCCAGGGCAGGCCAUUCCU | 1163 | fC*fC*fC*fC*fA*fG*mG*mG*mC*mA*mG*mG*mC*mC*fA*fU*fU*fC*fC*fU XXXXX | 1272 | XXXXXXXXXXXXXX | DMD mouse Exon23 | DMD |
| WV-4651 | CCCCCAGGGCAGGCCAUUCC | 1164 | fC*fC*fC*fC*fC*fA*mG*mG*mG*mC*mA*mG*mG*mC*fC*fA*fU*fU*fC*fC | 1273 | XXXXXXXXXXXXXXXXXXX | DMD mouse Exon23 | DMD |

TABLE 4-continued

| Example Oligonucleotides | | | | | | | |
|---|---|---|---|---|---|---|---|
| WAVE ID | Base Sequence | SEQ ID NO: | Description | SEQ ID NO: | Stereochemistry[1] | Notes | Target/Program |
| WV-4652 | UCCCCCAGGGCAGGCCAUUC | 1165 | fU*fC*fC*fC*fC*fC*mA*mG*mG*mG*mC*mA*mG*mG*fC*fC*fA*fU*fU*fC | 1274 | XXXXXXXXXXXXXXXXXXX | DMD mouse Exon23 | DMD |
| WV-4653 | AUCCCCCAGGGCAGGCCAUU | 1166 | fA*fU*fC*fC*fC*fC*mC*mA*mG*mG*mG*mC*mA*mG*fG*fC*fC*fA*fU*fU | 1275 | XXXXXXXXXXXXXXXXXXX | DMD mouse Exon23 | DMD |
| WV-4654 | CAUCCCCCAGGGCAGGCCAU | 1167 | fC*fA*fU*fC*fC*fC*mC*mC*mA*mG*mG*mG*mC*mA*fG*fG*fC*fC*fA*fU | 1276 | XXXXXXXXXXXXXXXXXXX | DMD mouse Exon23 | DMD |
| WV-4655 | GCAUCCCCCAGGGCAGGCCA | 1168 | fG*fC*fA*fU*fC*fC*mC*mC*mC*mA*mG*mG*mG*mC*fA*fG*fG*fC*fC*fA | 1277 | XXXXXXXXXXXXXXXXXXX | DMD mouse Exon23 | DMD |
| WV-4656 | AGCAUCCCCCAGGGCAGGCC | 1169 | fA*fG*fC*fA*fU*fC*mC*mC*mC*mC*mA*mG*mG*mG*fC*fA*fG*fG*fC*fC | 1278 | XXXXXXXXXXXXXXXXXXX | DMD mouse Exon23 | DMD |
| WV-4657 | CAGCAUCCCCCAGGGCAGGC | 1170 | fC*fA*fG*fC*fA*fU*mC*mC*mC*mC*mC*mA*mG*mG*fG*fC*fA*fG*fG*fC | 1279 | XXXXXXXXXXXXXXXXXXX | DMD mouse Exon23 | DMD |
| WV-4658 | UCAGCAUCCCCCAGGGCAGG | 1171 | fU*fC*fA*fG*fC*fA*mU*mC*mC*mC*mC*mC*mA*mG*fG*fG*fC*fA*fG*fG | 1280 | XXXXXXXXXXXXXXXXXXX | DMD mouse Exon23 | DMD |
| WV-4659 | UUCAGCAUCCCCCAGGGCAG | 1172 | fU*fU*fC*fA*fG*fC*mA*mU*mC*mC*mC*mC*mC*mA*fG*fG*fG*fC*fA*fG | 1281 | XXXXXXXXXXXXXXXXXXX | DMD mouse Exon23 | DMD |
| WV-4660 | UUUCAGCAUCCCCCAGGGCA | 1173 | fU*fU*fU*fC*fA*fG*mC*mA*mU*mC*mC*mC*mC*mC*fA*fG*fG*fG*fC*fA | 1282 | XXXXXXXXXXXXXXXXXXX | DMD mouse Exon23 | DMD |

TABLE 4-continued

| Example Oligonucleotides | | | | | | | |
|---|---|---|---|---|---|---|---|
| WAVE ID | Base Sequence | SEQ ID NO: | Description | SEQ ID NO: | Stereochemistry[1] | Notes | Target/Program |
| WV-4661 | AUUUCAGCAUCCCCCAGGGC | 1174 | fA*fU*fU*fU*fC*fA*mG*mC*mA*mU*mC*mC*mC*mC*fC*fA*fG*fG*fG*fC | 1283 | XXXXXXXXXXXXXXXXXXX | DMD mouse Exon23 | DMD |
| WV-4662 | GAUUUCAGCAUCCCCCAGGG | 1175 | fG*fA*fU*fU*fU*fC*mA*mG*mC*mA*mU*mC*mC*mC*fC*fC*fA*fG*fG*fG | 1284 | XXXXXXXXXXXXXXXXXXX | DMD mouse Exon23 | DMD |
| WV-4663 | GGAUUUCAGCAUCCCCCAGG | 1176 | fG*fG*fA*fU*fU*fU*mC*mA*mG*mC*mA*mU*mC*mC*fC*fC*fC*fA*fG*fG | 1285 | XXXXXXXXXXXXXXXXXXX | DMD mouse Exon23 | DMD |
| WV-4664 | AGGAUUUCAGCAUCCCCCAG | 1177 | fA*fG*fG*fA*fU*fU*mU*mC*mA*mG*mC*mA*mU*mC*fC*fC*fC*fC*fA*fG | 1286 | XXXXXXXXXXXXXXXXXXX | DMD mouse Exon23 | DMD |
| WV-4665 | CAGGAUUUCAGCAUCCCCCA | 1178 | fC*fA*fG*fG*fA*fU*mU*mU*mC*mA*mG*mC*mA*mU*fC*fC*fC*fC*fC*fA | 1287 | XXXXXXXXXXXXXXXXXXX | DMD mouse Exon23 | DMD |
| WV-4666 | UCAGGAUUUCAGCAUCCCCC | 1179 | fU*fC*fA*fG*fG*fA*mU*mU*mU*mC*mA*mG*mC*mA*fU*fC*fC*fC*fC*fC | 1288 | XXXXXXXXXXXXXXXXXXX | DMD mouse Exon23 | DMD |
| WV-4667 | UUCAGGAUUUCAGCAUCCCC | 1180 | fU*fU*fC*fA*fG*fG*mA*mU*mU*mU*mC*mA*mG*mC*fA*fU*fC*fC*fC*fC | 1289 | XXXXXXXXXXXXXXXXXXX | DMD mouse Exon23 | DMD |
| WV-4668 | UUUCAGGAUUUCAGCAUCCC | 1181 | fU*fU*fU*fC*fA*fG*mG*mA*mU*mU*mU*mC*mA*mG*fC*fA*fU*fC*fC*fC | 1290 | XXXXXXXXXXXXXXXXXXX | DMD mouse Exon23 | DMD |
| WV-4669 | UUUUCAGGAUUUCAGCAUCC | 1182 | fU*fU*fU*fU*fC*fA*mG*mG*mA*mU*mU*mU*mC*mA*fG*fC*fA*fU*fC*fC | 1291 | XXXXXXXXXXXXXXXXXXX | DMD mouse Exon23 | DMD |

TABLE 4-continued

| Example Oligonucleotides | | | | | | | |
|---|---|---|---|---|---|---|---|
| WAVE ID | Base Sequence | SEQ ID NO: | Description | SEQ ID NO: | Stereochemistry[1] | Notes | Target/Program |
| WV-4670 | UUUUUCAGGAUUUCAGCAUC | 1183 | fU*fU*fU*fU*fU*fC*mA*mG*mG*mA*mU*mU*mU*mC*fA*fG*fC*fA*fU*fC | 1292 | XXXXXXXXXXXXXXXXXXX | DMD mouse Exon23 | DMD |
| WV-4671 | UUUUUUCAGGAUUUCAGCAU | 1184 | fU*fU*fU*fU*fU*fU*mC*mA*mG*mG*mA*mU*mU*mU*fC*fA*fG*fC*fA*fU | 1293 | XXXXXXXXXXXXXXXXXXX | DMD mouse Exon23 | DMD |
| WV-4672 | GUUUUUUCAGGAUUUCAGCA | 1185 | fG*fU*fU*fU*fU*fU*mU*mC*mA*mG*mG*mA*mU*mU*fU*fC*fA*fG*fC*fA | 1294 | XXXXXXXXXXXXXXXXXXX | DMD mouse Exon23 | DMD |
| WV-4673 | UGUUUUUUCAGGAUUUCAGC | 1186 | fU*fG*fU*fU*fU*fU*mU*mU*mC*mA*mG*mG*mA*mU*fU*fU*fC*fA*fG*fC | 1295 | XXXXXXXXXXXXXXXXXXX | DMD mouse Exon23 | DMD |
| WV-4674 | CUGUUUUUUCAGGAUUUCAG | 1187 | fC*fU*fG*fU*fU*fU*mU*mU*mU*mC*mA*mG*mG*mA*fU*fU*fU*fC*fA*fG | 1296 | XXXXXXXXXXXXXXXXXXX | DMD mouse Exon23 | DMD |
| WV-4675 | GCUGUUUUUUCAGGAUUUCA | 1188 | fG*fC*fU*fG*fU*fU*mU*mU*mU*mU*mC*mA*mG*mG*fA*fU*fU*fU*fC*fA | 1297 | XXXXXXXXXXXXXXXXXXX | DMD mouse Exon23 | DMD |
| WV-4676 | AGCUGUUUUUUCAGGAUUUC | 1189 | fA*fG*fC*fU*fG*fU*mU*mU*mU*mU*mU*mC*mA*mG*fG*fA*fU*fU*fU*fC | 1298 | XXXXXXXXXXXXXXXXXXX | DMD mouse Exon23 | DMD |
| WV-4677 | GAGCUGUUUUUUCAGGAUUU | 1190 | fG*fA*fG*fC*fU*fG*mU*mU*mU*mU*mU*mU*mC*mA*fG*fG*fA*fU*fU*fU | 1299 | XXXXXXXXXXXXXXXXXXX | DMD mouse Exon23 | DMD |
| WV-4678 | UGAGCUGUUUUUUCAGGAUU | 1191 | fU*fG*fA*fG*fC*fU*mG*mU*mU*mU*mU*mU*mU*mC*fA*fG*fG*fA*fU*fU | 1300 | XXXXXXXXXXXXXXXXXXX | DMD mouse Exon23 | DMD |

TABLE 4-continued

| Example Oligonucleotides | | | | | | | |
|---|---|---|---|---|---|---|---|
| WAVE ID | Base Sequence | SEQ ID NO: | Description | SEQ ID NO: | Stereochemistry[1] | Notes | Target/Program |
| WV-4679 | UUGAGCUGUUUUUUCAGGAU | 1192 | fU*fU*fG*fA*fG*fC*mU*mG*mU*mU*mU*mU*mU*mU*fC*fA*fG*fG*fA*fU | 1301 | XXXXXXXXXXXXXXXXXXX | DMD mouse Exon23 | DMD |
| WV-4680 | UUUGAGCUGUUUUUUCAGGA | 1193 | fU*fU*fU*fG*fA*fG*mC*mU*mG*mU*mU*mU*mU*mU*fU*fC*fA*fG*fG*fA | 1302 | XXXXXXXXXXXXXXXXXXX | DMD mouse Exon23 | DMD |
| WV-4681 | GUUUGAGCUGUUUUUUCAGG | 1194 | fG*fU*fU*fU*fG*fA*mG*mC*mU*mG*mU*mU*mU*mU*fU*fU*fC*fA*fG*fG | 1303 | XXXXXXXXXXXXXXXXXXX | DMD mouse Exon23 | DMD |
| WV-4682 | UUGUUUGAGCUGUUUUUUCA | 1195 | fU*fU*fG*fU*fU*fU*mG*mA*mG*mC*mU*mG*mU*mU*fU*fU*fU*fU*fC*fA | 1304 | XXXXXXXXXXXXXXXXXXX | DMD mouse Exon23 | DMD |
| WV-4683 | CAUUGUUUGAGCUGUUUUUU | 1196 | fC*fA*fU*fU*fG*fU*mU*mU*mG*mA*mG*mC*mU*mG*fU*fU*fU*fU*fU*fU | 1305 | XXXXXXXXXXXXXXXXXXX | DMD mouse Exon23 | DMD |
| WV-4684 | GCAUUGUUUGAGCUGUUUUU | 1197 | fG*fC*fA*fU*fU*fG*mU*mU*mU*mG*mA*mG*mC*mU*fG*fU*fU*fU*fU*fU | 1306 | XXXXXXXXXXXXXXXXXXX | DMD mouse Exon23 | DMD |
| WV-4685 | UGCAUUGUUUGAGCUGUUUU | 1198 | fU*fG*fC*fA*fU*fU*mG*mU*mU*mU*mG*mA*mG*mC*fU*fG*fU*fU*fU*fU | 1307 | XXXXXXXXXXXXXXXXXXX | DMD mouse Exon23 | DMD |
| WV-4686 | CUGCAUUGUUUGAGCUGUUU | 1199 | fC*fU*fG*fC*fA*fU*mU*mG*mU*mU*mU*mG*mA*mG*fC*fU*fG*fU*fU*fU | 1308 | XXXXXXXXXXXXXXXXXXX | DMD mouse Exon23 | DMD |
| WV-4687 | UCUGCAUUGUUUGAGCUGUU | 1200 | fU*fC*fU*fG*fC*fA*mU*mU*mG*mU*mU*mU*mG*mA*fG*fC*fU*fG*fU*fU | 1309 | XXXXXXXXXXXXXXXXXXX | DMD mouse Exon23 | DMD |

TABLE 4-continued

Example Oligonucleotides

| WAVE ID | Base Sequence | SEQ ID NO: | Description | SEQ ID NO: | Stereochemistry[1] | Notes | Target/Program |
|---|---|---|---|---|---|---|---|
| WV-4688 | CUCUGCAUUGUUUGAGCUGU | 1201 | fC*fU*fC*fU*fG*fC*mA*mU*mU*mG*mU*mU*mU*mG*fA*fG*fC*fU*fG*fU | 1310 | XXXXXXXXXXXXXXXXXXX | DMD mouse Exon23 | DMD |
| WV-4689 | ACUCUGCAUUGUUUGAGCUG | 1202 | fA*fC*fU*fC*fU*fG*mC*mA*mU*mU*mG*mU*mU*mU*fG*fA*fG*fC*fU*fG | 1311 | XXXXXXXXXXXXXXXXXXX | DMD mouse Exon23 | DMD |
| WV-4690 | UACUCUGCAUUGUUUGAGCU | 1203 | fU*fA*fC*fU*fC*fU*mG*mC*mA*mU*mU*mG*mU*mU*fU*fG*fA*fG*fC*fU | 1312 | XXXXXXXXXXXXXXXXXXX | DMD mouse Exon23 | DMD |
| WV-4691 | UUACUCUGCAUUGUUUGAGC | 1204 | fU*fU*fA*fC*fU*fC*mU*mG*mC*mA*mU*mU*mG*mU*fU*fU*fG*fA*fG*fC | 1313 | XXXXXXXXXXXXXXXXXXX | DMD mouse Exon23 | DMD |
| WV-4692 | CUUACUCUGCAUUGUUUGAG | 1205 | fC*fU*fU*fA*fC*fU*mC*mU*mG*mC*mA*mU*mU*mG*fU*fU*fU*fG*fA*fG | 1314 | XXXXXXXXXXXXXXXXXXX | DMD mouse Exon23 | DMD |
| WV-4693 | UCUUACUCUGCAUUGUUUGA | 1206 | fU*fC*fU*fU*fA*fC*mU*mC*mU*mG*mC*mA*mU*mU*fG*fU*fU*fU*fG*fA | 1315 | XXXXXXXXXXXXXXXXXXX | DMD mouse Exon23 | DMD |
| WV-4694 | AUCUUACUCUGCAUUGUUUG | 1207 | fA*fU*fC*fU*fU*fA*mC*mU*mC*mU*mG*mC*mA*mU*fU*fG*fU*fU*fU*fG | 1316 | XXXXXXXXXXXXXXXXXXX | DMD mouse Exon23 | DMD |
| WV-4695 | AAUCUUACUCUGCAUUGUUU | 1208 | fA*fA*fU*fC*fU*fU*mA*mC*mU*mC*mU*mG*mC*mA*fU*fU*fG*fU*fU*fU | 1317 | XXXXXXXXXXXXXXXXXXX | DMD mouse Exon23 | DMD |
| WV-4696 | CAAAUCUUACUCUGCAUUGU | 1209 | fC*fA*fA*fA*fU*fC*mU*mU*mA*mC*mU*mC*mU*mG*fC*fA*fU*fU*fG*fU | 1318 | XXXXXXXXXXXXXXXXXXX | DMD mouse Exon23 | DMD |

TABLE 4-continued

| Example Oligonucleotides | | | | | | | |
|---|---|---|---|---|---|---|---|
| WAVE ID | Base Sequence | SEQ ID NO: | Description | SEQ ID NO: | Stereochemistry[1] | Notes | Target/Program |
| WV-4697 | GAUACAAAUCUUACUCUGCA | 1210 | fG*fA*fU*fA*fC*fA*mA*mA*mU*mC*mU*mU*mA*mC*fU*fC*fU*fG*fC*fA | 1319 | XXXXXXXXXXXXXXXXXXX | DMD mouse Exon23 | DMD |
| WV-2735 | GGGTCAGCTGCCAATGCTAG | 1211 | Geo*Geo*Geo*Teo*m5Ceo*A*G*C*T*G*C*C*A*A*T*Geo*m5Ceo*Teo*Aeo*Geo | 1320 | XXXXXXXXXXXXXXXXXXX | Randomer | Targets Malat1 |
| WV-3521 | GGGTCAGCTGCCAATGCTAG | 1211 | Mod030Geo*Geo*Geo*Teo*m5Ceo*A*G*C*T*G*C*C*A*A*T*Geo*m5Ceo*Teo*Aeo*Geo | 1321 | OXXXXXXXXXXXXXXXXXXX | WV-2735 based; with PO linker, Laurie | Targets Malat1 |
| WV-3522 | GGGTCAGCTGCCAATGCTAG | 1211 | Mod031Geo*Geo*Geo*Teo*m5Ceo*A*G*C*T*G*C*C*A*A*T*Geo*m5Ceo*Teo*Aeo*Geo | 1322 | OXXXXXXXXXXXXXXXXXXX | WV-2735 based; with PO linker, Myristic | Targets Malat1 |
| WV-3523 | GGGTCAGCTGCCAATGCTAG | 1211 | Mod032Geo*Geo*Geo*Teo*m5Ceo*A*G*C*T*G*C*C*A*A*T*Geo*m5Ceo*Teo*Aeo*Geo | 1323 | OXXXXXXXXXXXXXXXXXXX | WV-2735 based; with PO linker, Palmitic | Targets Malat1 |
| WV-3524 | GGGTCAGCTGCCAATGCTAG | 1211 | Mod033Geo*Geo*Geo*Teo*m5Ceo*A*G*C*T*G*C*C*A*A*T*Geo*m5Ceo*Teo*Aeo*Geo | 1324 | OXXXXXXXXXXXXXXXXXXX | WV-2735 based; with PO linker, Stearic | Targets Malat1 |

[1] Including —C(O)— (noted as O) connecting Mod and the amino group of C6 amino linker and phosphate or phosphorothioate linkage connecting C6 amino linker and oligonucleotide chain (noted as X (stereorandom), S (Sp) or R (Sp)).

Abbreviations:

2\': 2'

5Ceo: 5-Methyl 2'-Methoxyethyl C

C6: C6 amino linker (L001, —NH—$(CH_2)_6$— wherein —NH— is connected to Mod (through —C(O)—) or —H, and —$(CH_2)_6$— is connected to the 5'-end of oligonucleotide chain through, e.g., phosphodiester (illustrated in the Table as O or PO), phosphorothioate (illustrated in the Table as * if the phosphorothioate not chirally controlled; *S, S, or Sp, if chirally controlled and has an Sp configuration, and *R, R, or Rp, if chirally controlled and has an Rp configuration), or phosphorodithioate (illustrated in the Table as PS2 or:). May also be referred to as C6 linker or C6 amine linker)

eo: 2'-MOE

Exon: Exon of Dystrophin

F, f: 2'-F

Lauric (in Mod013), Myristic (in Mod014), Palmitic (in Mod005), Stearic (in Mod015), Oleic (in Mod016), Linoleic (in Mod017), alpha-Linoleine (in Mod018), gamma-Linolenic (in Mod019), DHA (in Mod006), Turbinaric (in Mod020), Dilinoleic (in Mod021), TriGlcNAc (in Mod024), TrialphaMannose (in Mod026), MonoSulfonamide (in Mod 027), TriSulfonamide (in Mod029), Lauric (in Mod030), Myristic (in Mod031), Palmitic (in Mod032), and Stearic (in Mod033): Lauric acid (for Mod013), Myristic acid (for Mod014), Palmitic acid (for Mod005), Stearic acid (for Mod015), Oleic acid (for Mod016), Linoleic acid (for Mod017), alpha-Linolenic acid (for Mod018), gamma-Linolenic acid (for Mod019), docosahexaenoic acid (for Mod006), Turbinaric acid (for Mod020), alcohol for Dilinoleyl (for Mod021), acid for TriGlcNAc (for Mod024), acid for TrialphaMannose (for Mod026), acid for MonoSulfonamide (for Mod 027), acid for TriSulfonamide (for Mod029), Lauryl alcohol (for Mod030), Myristyl alcohol (for Mod031), Palmityl alcohol (for Mod032), and Stearyl alcohol (for Mod033), respectively, conjugated to oligonucleotide chains through amide groups, C6 amino linker, phosphodiester linkage (PO), and/or phosphorothioate linkage (PS): Mod013 (Lauric acid with C6 amino linker and PO or PS), Mod014 (Myristic acid with C6 amino linker and PO or PS), Mod005 (Palmitic acid with C6 amino linker and PO or PS), Mod015 (Stearic acid with C6 amino linker and PO or PS), Mod016 (Oleic acid with C6 amino linker and PO or PS), Mod017 (Linoleic acid with C6 amino linker and PO or PS), Mod018 (alpha-Linolenic acid with C6 amino linker and PO or PS), Mod019 (gamma-Linolenic acid with C6 amino linker and PO or PS), Mod006 (DHA with C6 amino linker and PO or PS), Mod020 (Turbinaric acid with C6 amino linker and PO or PS), Mod021 (alcohol (see below) with PO or PS), Mod024 (acid (see below) with C6 amino linker and PO or PS), Mod026 (acid (see below) with C6 amino linker and PO or PS), Mod027 (acid (see below) with C6 amino linker and PO or PS), Mod029 (acid (see below) with C6 amino linker and PO or PS), Mod030 (Lauryl alcohol with PO or PS), Mod031 (Myristyl alcohol with PO or PS), Mod032 (Palmityl alcohol with PO or PS), and Mod033 (Stearyl alcohol with PO or PS), with PO or PS for each oligonucleotide indicated in the Table (for example, WV-3473 Lauric acid conjugated to oligonucleotide chain of WV-3473 via amide group, C6, and PO: Mod013L001fU*SfC*SfA*SfA*SfG*SfG*SmAfA*SmGmA*SfU*SmGmGfC*SfA*SfU*SfU*SfU*SfC*SfU (SEQ ID NO: 836) (Description), OOSSSSSSOSOSSOOSSSSSS (Stereochemistry), and/or WV-3473, Lauric acid, C6 PO linker (Notes);

WV-3557 Steary alcohol conjugated to oligonucleotide chain of WV-3473 via PS: Mod033*fU*SfC*SfA*SfA*SfG*SfG*SmAfA*SmGmA*SfU*SmGmGfC*SfA*SfJ*SJfU*SfU*SfC*SfJ (SEQ ID NO: 850) (Description), XSSSSSSOSOSSOOSSSSSS (Stereochemistry), and/or WV-3473, Stearic PS (Notes); and WV-4106 Stearic acid conjugated to oligonucleotide chain of WV-3473 via amide group, C6, and PS: Mod015L001*fU*SfC*SfA*SfA*SfG*SfG*SmAfA*SmGmA*SfU*SmGmGfC*SfA*SfU*SfU*SfJ*SfC*SfJ (SEQ ID NO: 868) (Description), OXSSSSSSOSOSSOOSSSSSS (Stereochemistry), and/or WV-3473, C6 PS linker, Stearic acid (Notes)).

Moieties for conjugation, and example reagents (many of which were previously known and are commercially available or can be readily prepared using known technologies in accordance with the present disclosure, e.g., Lauric acid (for Mod013), Myristic acid (for Mod014), Palmitic acid (for Mod005), Stearic acid (for Mod015), Oleic acid (for Mod016), Linoleic acid (for Mod017), alpha-Linolenic acid (for Mod018), gamma-Linolenic acid (for Mod019), docosahexaenoic acid (for Mod006), Turbinaric acid (for Mod020), alcohol for Dilinoleyl (for Mod021), Lauryl alcohol (for Mod030), Myristyl alcohol (for Mod031), Palmityl alcohol (for Mod032), Stearyl alcohol (for Mod033), etc.) are listed below m: 2'-OMe NA: Not Applicable; this term is generally used for negative controls OMe: 2'-OMe O, PO: phoshodiester (phosphate), or when used with Mod and L001, —C(O)— (connecting Mod and L001, for example, Mod013L001fU*SfC*SfA*SfA*SfG*SfG*SmAfA*SmGmA*SfU*SmGmGfC*SfA*SfJ*SfU*SfU*SfC*SfJ (SEQ ID NO: 836) (Description), OOSSSSSSOSOSSOOSSSSSS (Stereochemistry) and/or WV-3473, Lauric acid, C6 PO linker (Notes). Note the second O OOSSSSSSOSOSSOOSSSSSS (Stereochemistry) represents phosphodiester linkage connecting L001 and 5'-O— of oligonucleotide chain:

(SEQ ID NO: 836)

Mod013L001fU*SfC*SfA*SfA*SfG*SfG*SmAfA*SmGmA*SfU*SmGmGfC*SfA*SfU*SfU*SfU*SfC*SfU)

*, PS: Phosphorothioate

PS2: phosphorodithioate (e.g., WV-3078, wherein a colon (:) indicates a phosphorodithioate)

*R, R, Rp: Phosphorothioate in Rp conformation

*S, S, Sp: Phosphorothioate in Sp conformation

WV, W V—: WV—

X: Phosphorothioate stereorandom

Example moieties (e.g., lipid moieties, targeting component, etc.) and example preparation reagents (e.g., acids, alcohols, etc.) for conjugation to prepare provided oligonucleotides, e.g., example oligonucleotides in Tables 1-4 comprising such moieties, in accordance with the present disclosure include the below:

Mod005 (with —C(O)— connecting to —NH— of L001) and Palmitic acid

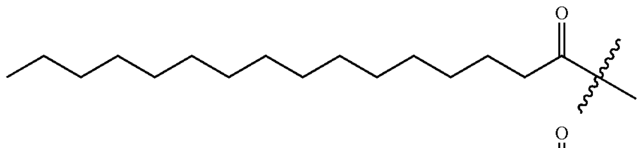

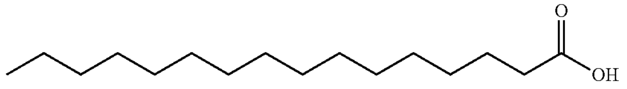

-continued

Mod005L001 (with PO or PS connecting to 5′ —O— of oligonucleotide chain)

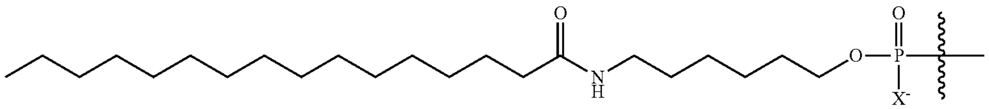

X = O or S

Mod006 (with —C(O)— connecting to —NH— of L001) and DHA

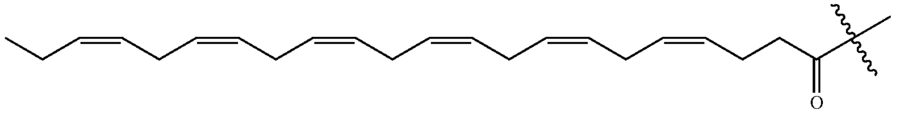

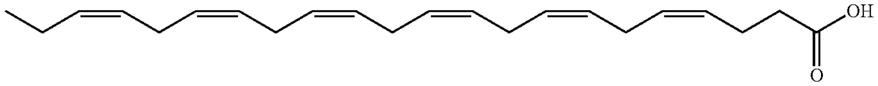

Mod006L001 (with PO or PS connecting to 5′ —O— of oligonucleotide chain)

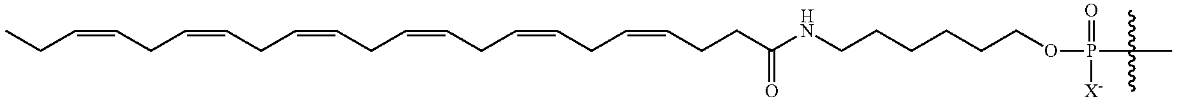

X = O or S

Mod013 (with —C(O)— connecting to —NH— of L001) and Lauric acid

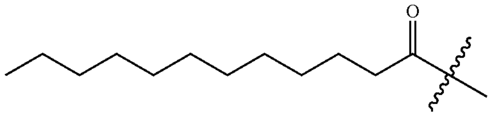

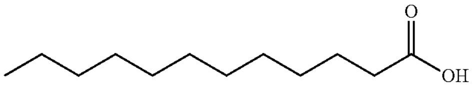

Mod013L001 (with PO or PS connecting to 5′ —O— of oligonucleotide chain)

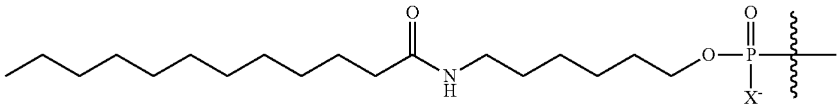

X = O or S

Mod014 (with —C(O)— connecting to —NH— of L001) and Myristic acid

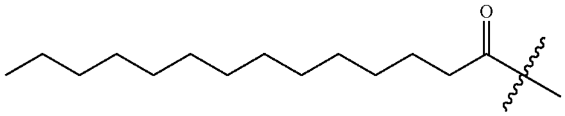

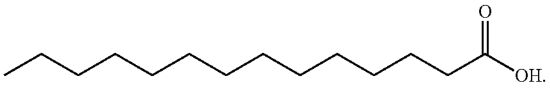

Mod014L001 (with PO or PS connecting to 5′ —O— of oligonucleotide chain)

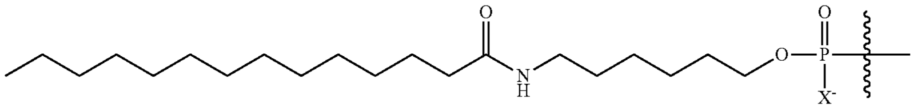

X = O or S

Mod015 (with —C(O)— connecting to —NH— of L001) and Stearic acid

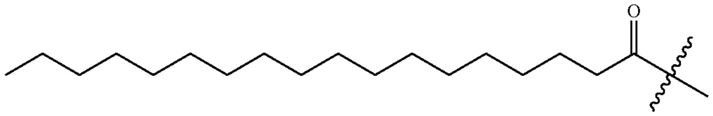

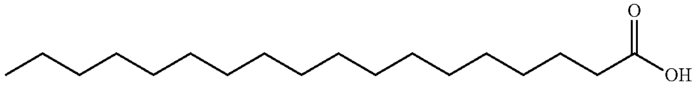

Mod015L001 (with PO or PS connecting to 5′ —O— of oligonucleotide chain)

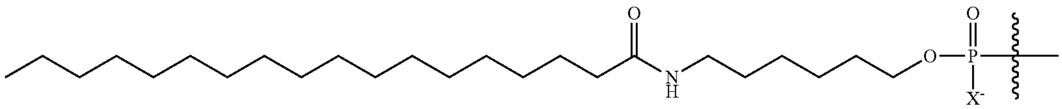

X = O or S

-continued

Mod016 (with —C(O)— connecting to —NH— of L001) and Oleic acid

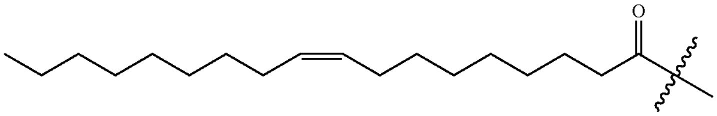

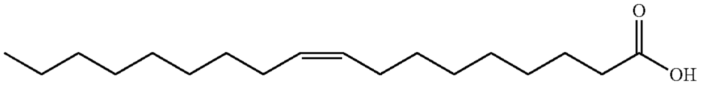

Mod016L001 (with PO or PS connecting to 5′ —O— of oligonucleotide chain)

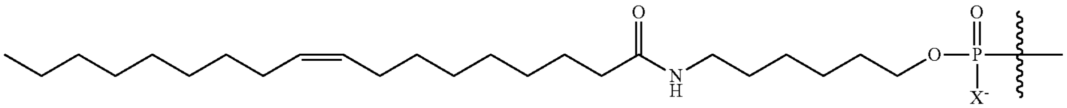

X = O or S

Mod017 (with —C(O)— connecting to —NH— of L001) and Linoleic acid

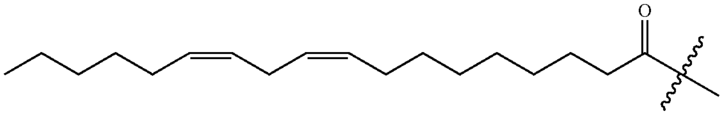

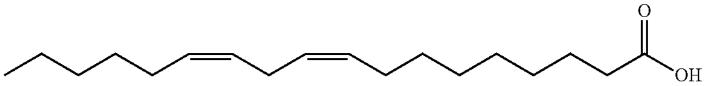

Mod017L001 (with PO or PS connecting to 5′ —O— of oligonucleotide chain)

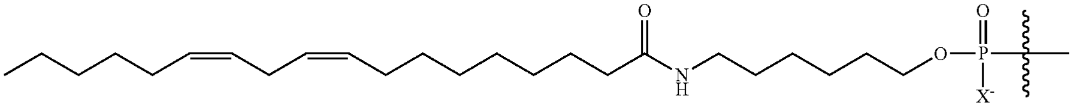

X = O or S

Mod018 (with —C(O)— connecting to —NH— of L001) and alpha-Linolenic acid

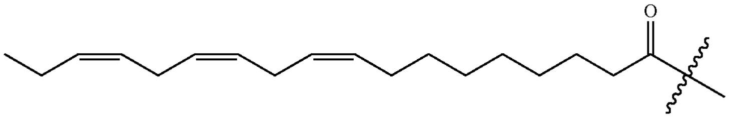

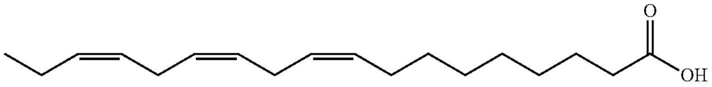

Mod018L001 (with PO or PS connecting to 5′ —O— of oligonucleotide chain)

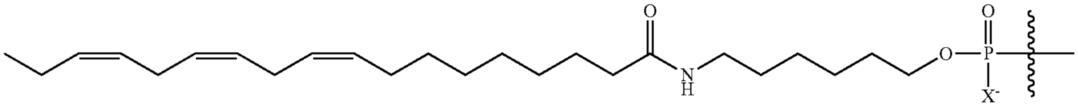

X = O or S

Mod019 (with —C(O)— connecting to —NH— of L001) and gamma-Linolenic acid

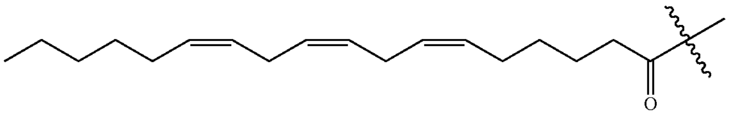

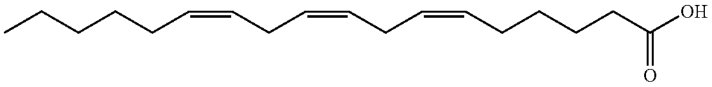

Mod019L001 (with PO or PS connecting to 5′ —O— of oligonucleotide chain)

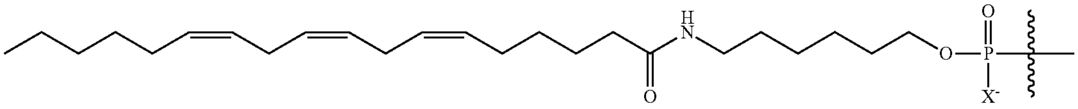

X = O or S

-continued
Mod020 (with —C(O)— connecting to —NH— of L001) and Turbinaric acid
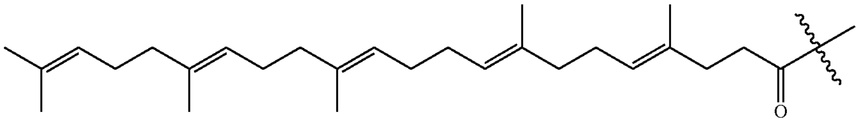
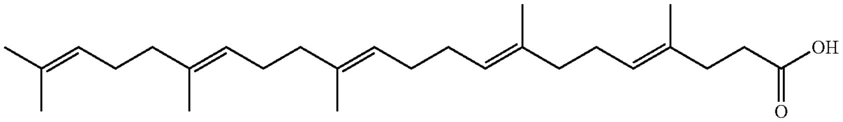
Mod020L001 (with PO or PS connecting to 5′ —O— of oligonucleotide chain)
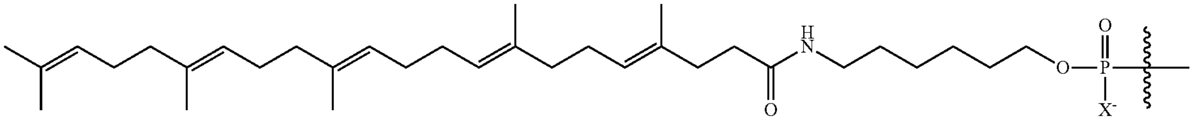
X = O or S
Mod021 (with PO or PS connecting to 5′ —O— of oligonucleotide chain) and alcohol
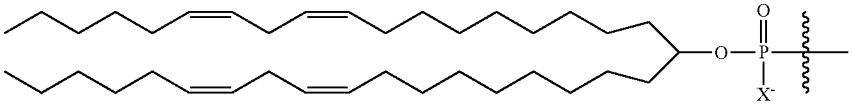
X = O or S
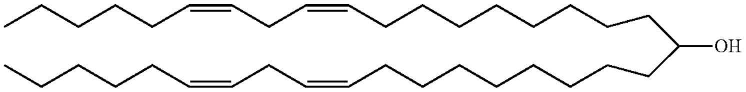
Mod024 (with —C(O)— connecting to —NH— of L001) and acid
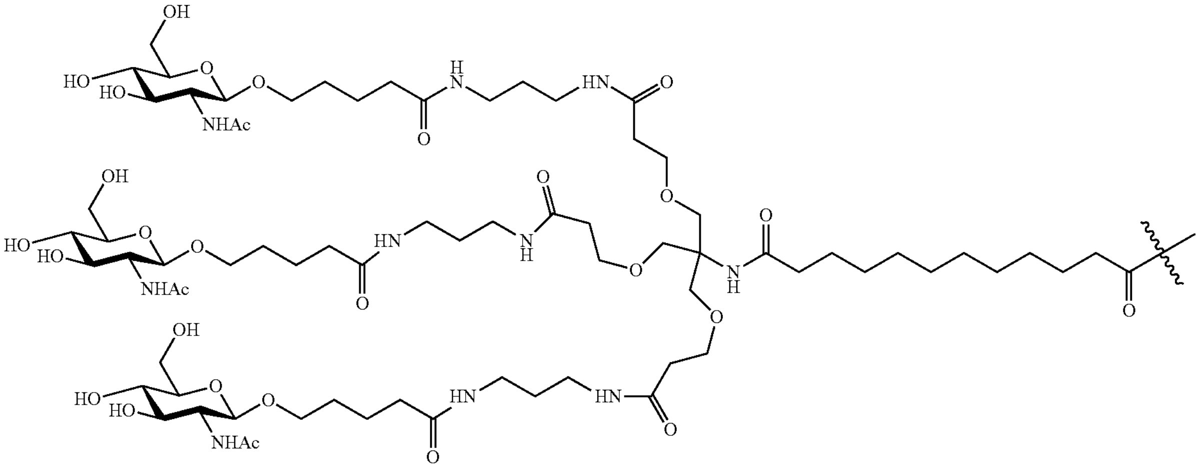
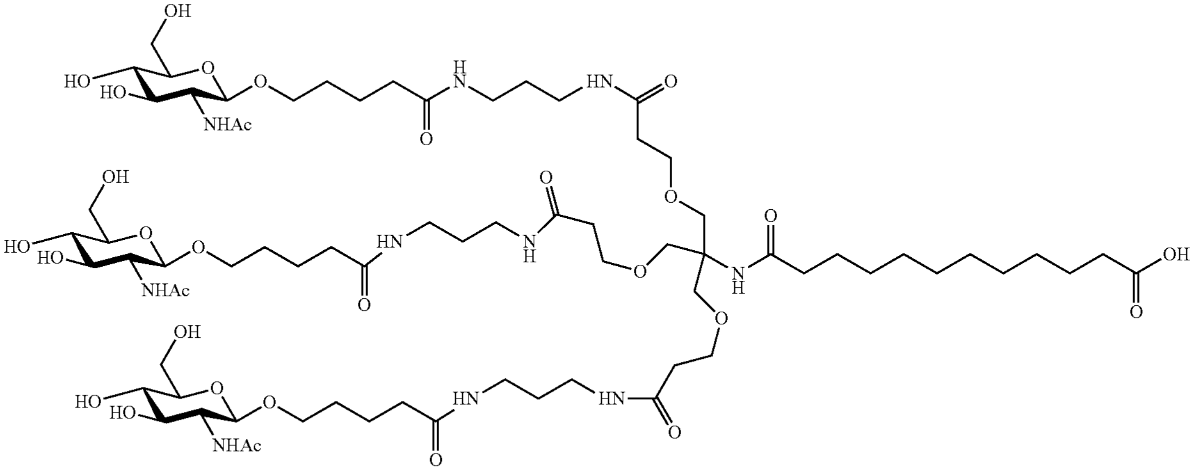

-continued
Mod024L001 (with PO or PS connecting to 5′ —O— of oligonucleotide chain)
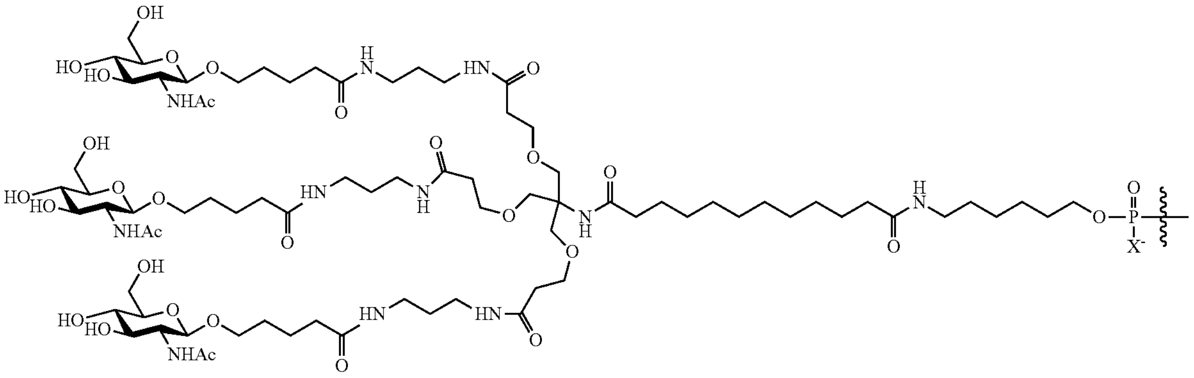
X = O or S
Mod026 (with —C(O)— connecting to —NH— of L001) and acid
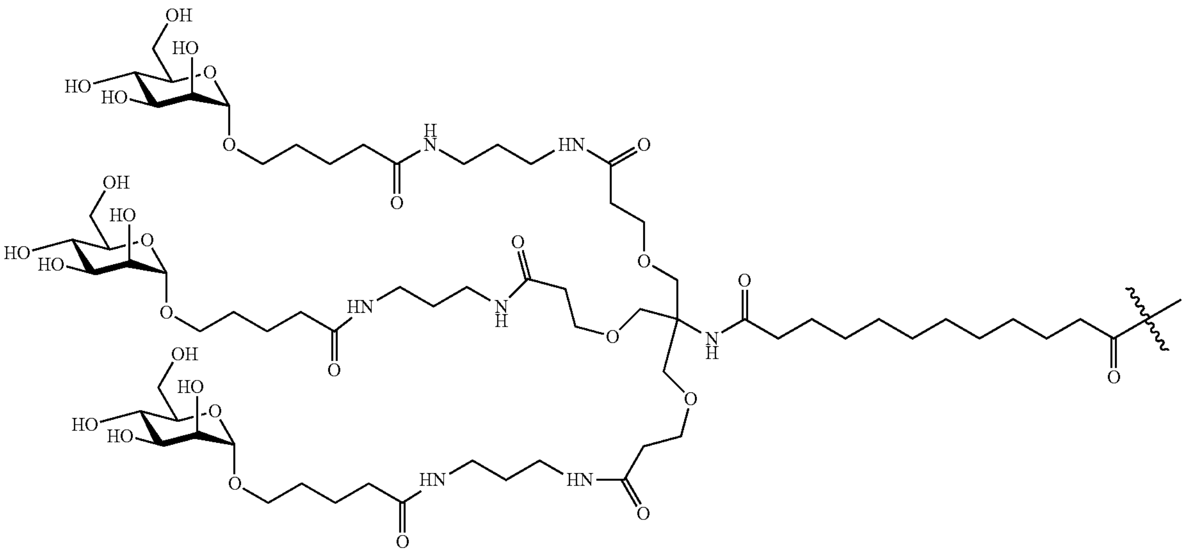
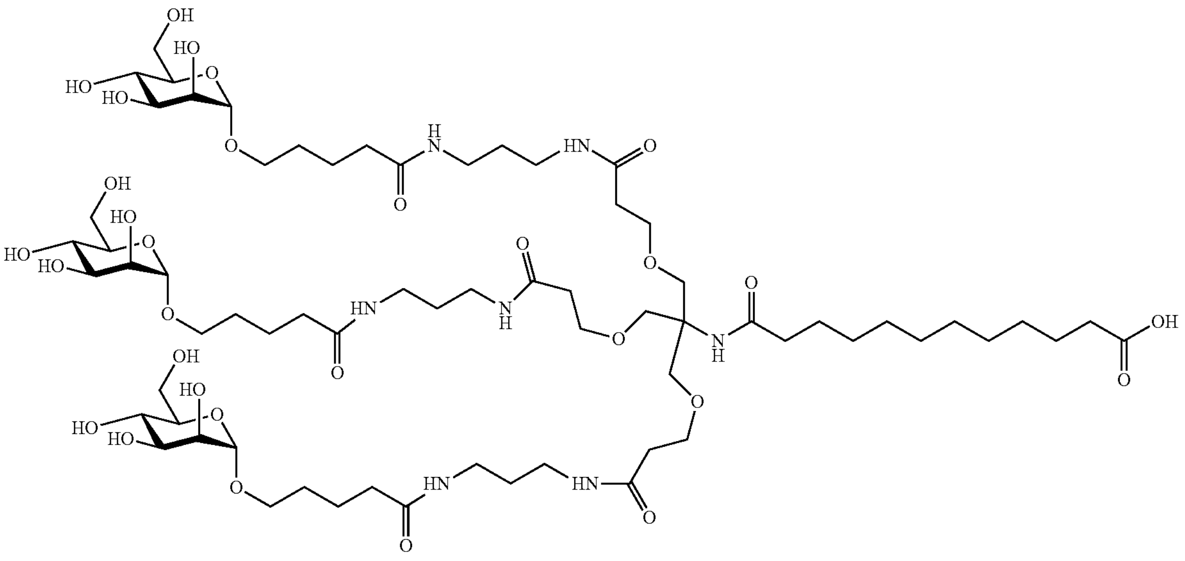

-continued
Mod026L001 (with PO or PS connecting to 5′ —O— of oligonucleotide chain)
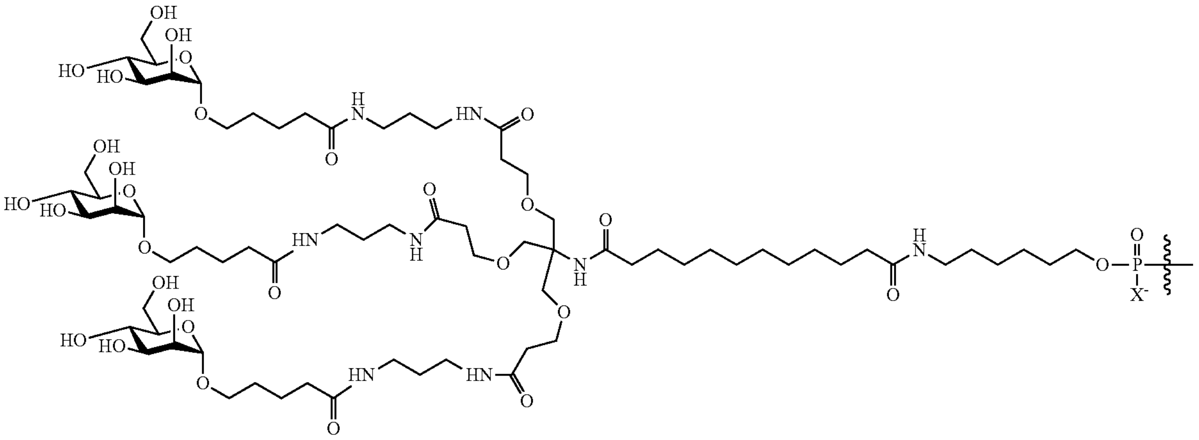
X = O or S
Mod027 (with —C(O)— connecting to —NH— of L001) and acid
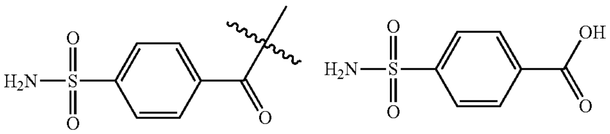
Mod027L001 (with PO or PS connecting to 5′ —O— of oligonucleotide chain)
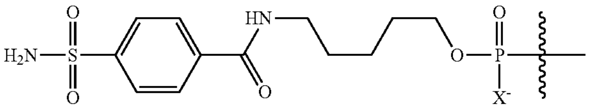
X = O or S
Mod029 (with —C(O)— connecting to —NH— of L001) and acid
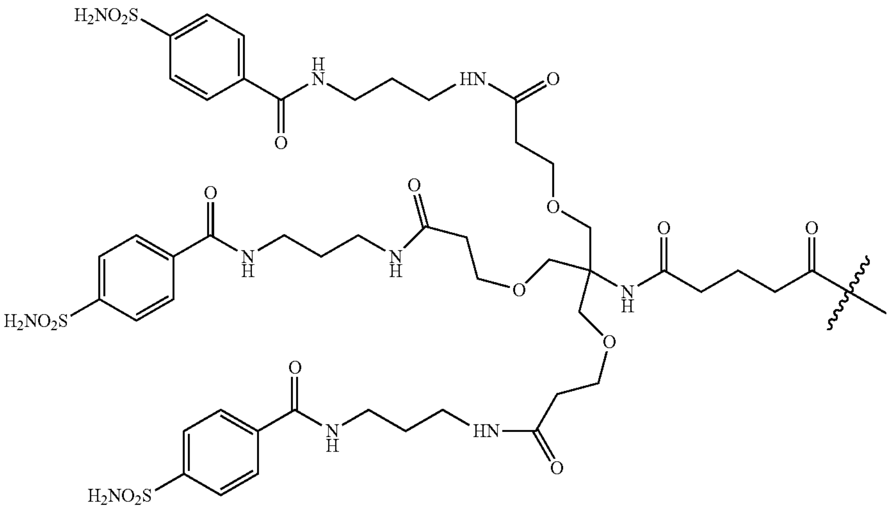

-continued
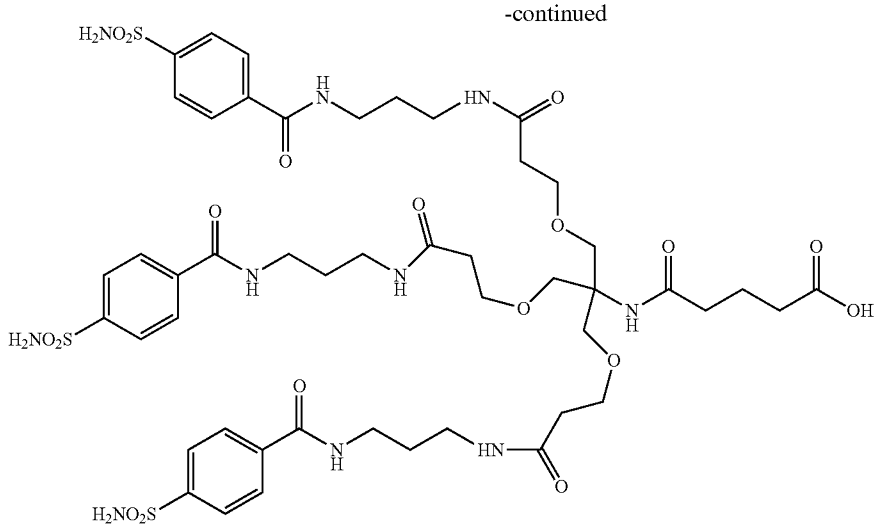
Mod029L001 (with PO or PS connecting to 5′ —O— of oligonucleotide chain)
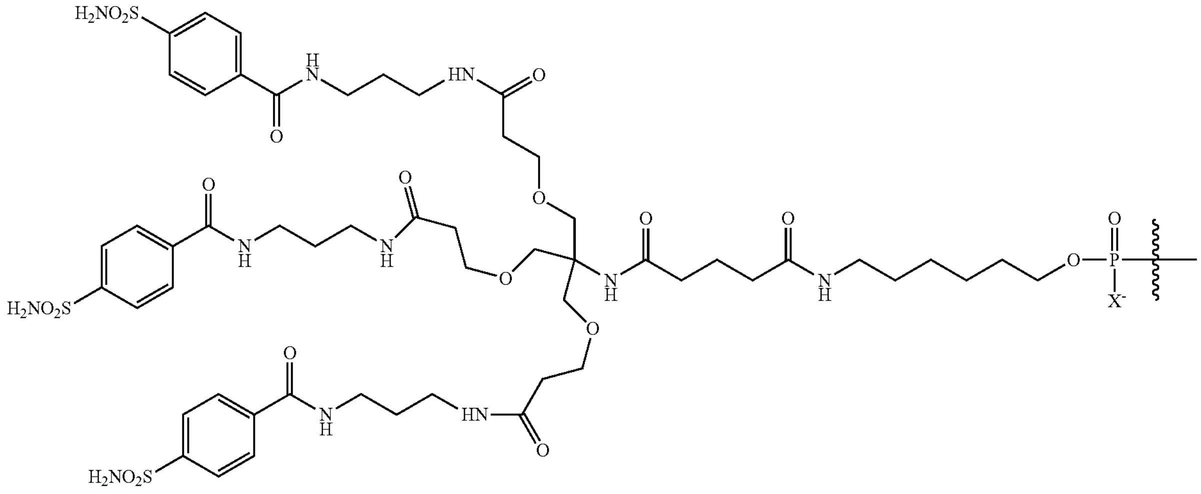
X = O or S
Mod030 (with PO or PS connecting to 5′ —O— of oligonucleotide chain) and Lauryl alcohol
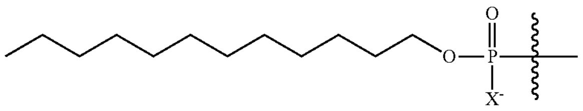
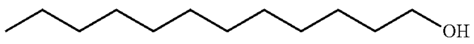
X = O or S
Mod031 (with PO or PS connecting to 5′ —O— of oligonucleotide chain) and Myristyl alcohol
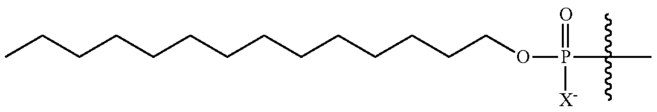
X = O or S
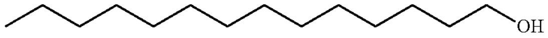
Mod032 (with PO or PS connecting to 5′ —O— of oligonucleotide chain) and Palmityl alcohol
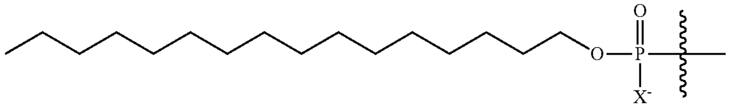
X = O or S
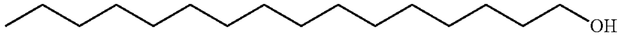

-continued

Mod033 (with PO or PS connecting to 5′ —O— of oligonucleotide chain) and Stearyl alcohol

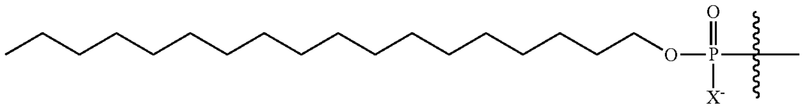

X = O or S

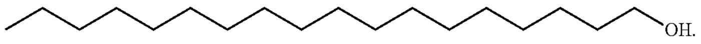

In some embodiments, for Mod024 and/or Mod 026, the hydroxyl groups are optionally protected as AcO—before and/or during conjugation to oligonucleotide chains, and the hydroxyl groups are deprotected, for example, during oligonucleotide cleavage and/or deprotection:

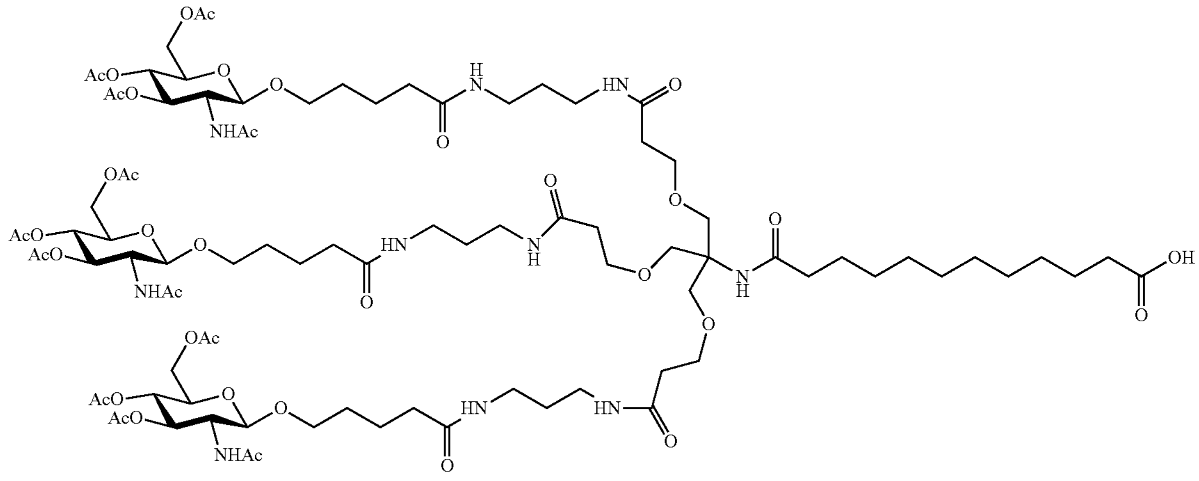

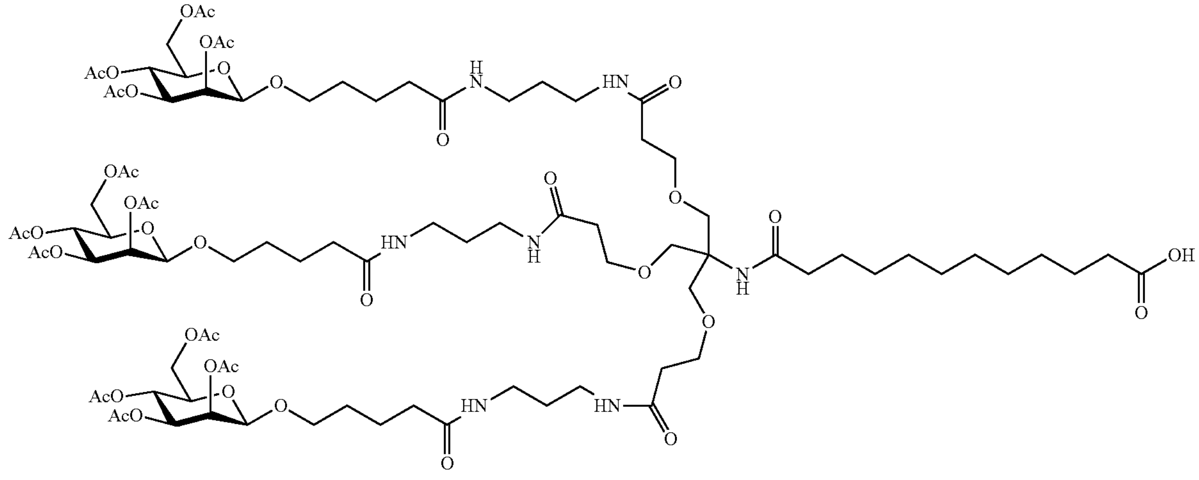

Applicant notes that presented above in the Table are example ways of presenting structures of provided oligonucleotides, for example, WV-3546 (Mod020L001fJ*SfC*SfA*SfA*SfG*SfG*SmAfA*SmGmA*SfUJ*SmGmGfC*SfA*SfU*SfU*SfJ*SfC*SfJ (SEQ ID NO: 839)) can be presented as a lipid moiety (Mod020, 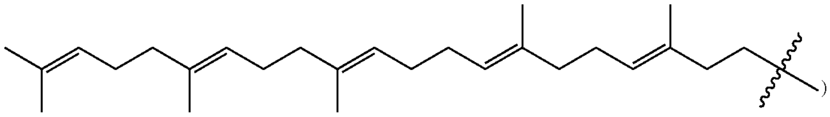 )

connected via —C(O)— (OOSSSSSSOSOSSOOSSSSSS) to the —NH— of —NH—$(CH_2)_6$—, wherein the —$(CH_2)_6$— is connected to the 5'-end of the oligonucleotide chain via a phosphodiester linkage (OOSSSSSSOSOSSOOSSSSSS). One having ordinary skill in the art understands that a provided oligonucleotide can be presented as combinations of lipid, linker and oligonucleotide chain units in many different ways, wherein in each way the combination of the units provides the same oligonucleotide. For example, WV-3546, can be considered to have a structure of $A^c$-[-$L^{LD}$-$(R^{LD})_a]_b$, wherein a is 1, b is 1, and have a lipid moiety $R^{LD}$ of

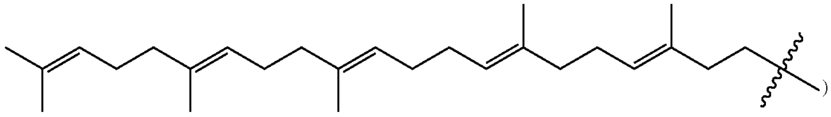 [SMILES: *CC/C(C)=C/CC/C(C)=C/CC/C=C(\C)CC/C=C(\C)CCC=C(C)C] )

connected to its oligonucleotide chain ($A^c$) portion through a linker $L^{LD}$ of —C(O)—NH—$(CH_2)_6$—OP(═O)(OH)—O—, wherein —C(O)— is connected to $R^{LD}$, and —O— is connected to $A^c$ (as 5'-O— of the oligonucleotide chain); one of the many alternative ways is that $R^{LD}$ is

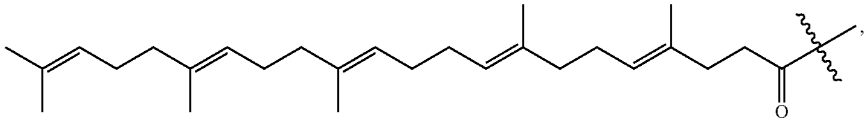 [SMILES: *C(=O)CC/C(C)=C/CC/C(C)=C/CC/C=C(\C)CC/C=C(\C)CCC=C(C)C] , and $L^{LD}$ is —NH—$(CH_2)_6$—OP(═O)(OH)—O—, wherein —NH— is connected to $R^{LD}$, and —O— is connected to $A^c$ (as 5'-O— of the oligonucleotide chain).

Oligonucleotides were prepared and characterized using a variety of methods in accordance of the present disclosure. Example MS data are presented below:

TABLE 6

Example MS data.

| WAVE ID | Calculated Mass | Found Mass |
|---|---|---|
| WV-2531 | 6767.90000 | 6766.3 |
| WV-3152 | 6743.77000 | 6742.8 |
| WV-3472 | 6720.78472 | 6720.8 |
| WV-3473 | 6732.82024 | 6735 |
| WV-3507 | 6716.75464 | 6717.3 |
| WV-3508 | 6704.71912 | 6706 |
| WV-3509 | 6716.75464 | 6718 |
| WV-3510 | 6716.75464 | 6717.6 |
| WV-3511 | 6728.79016 | 6731 |

TABLE 6-continued

Example MS data.

| WAVE ID | Calculated Mass | Found Mass |
|---|---|---|
| WV-3512 | 6700.68904 | 6702 |
| WV-3513 | 6712.72456 | 6713 |
| WV-3514 | 6688.65352 | 6688.9 |
| WV-3515 | 6700.68904 | 6701.2 |
| WV-3545 | 7178.43622 | 7178 |
| WV-3546 | 7294.59604 | 7295 |

*Calculated and found mass data of WV-2531 and WV-3152 are for sodium adducts.

In some embodiments, a provided oligonucleotide composition is a chirally controlled oligonucleotide composition of an oligonucleotide type listed in Table 2. In some embodiments, a provided oligonucleotide composition is a chirally controlled oligonucleotide composition of an oligonucleotide type listed in Table 2A-2E. In some embodiments, a provided oligonucleotide composition is a chirally controlled oligonucleotide composition of an oligonucleotide type listed in Table 2B-2E. In some embodiments, a provided composition is of WV-1092. In some embodiments, a provided composition is of WV-888. In some embodiments, a provided composition is of WV-892. In some embodiments, a provided composition is of WV-942. In some embodiments, a first plurality of oligonucleotides is a plurality of an oligonucleotide in Table 2. In some embodiments, a first plurality of oligonucleotides is a plurality of an oligonucleotide in Table 2A-2E. In some embodiments, a first plurality of oligonucleotides is a plurality of an oligonucleotide in Table 2B-2E. In some embodiments, a first plurality of oligonucleotides is a plurality of WV-1092. In some embodiments, a first plurality of oligonucleotides is a plurality of WV-888. In some embodiments, a first plurality of oligonucleotides is a plurality of WV-892. In some embodiments, a first plurality of oligonucleotides is a plurality of WV-896. In some embodiments, a first plurality of oligonucleotides is a plurality of an oligonucleotide in Table 4.

In some embodiments, a chemical modification pattern comprises a pattern selected from Table 3. In some embodiments, a provided stereochemistry pattern comprises a pattern selected from Table 3. In some embodiments, a provided stereochemistry pattern comprises a pattern selected from Table 3, wherein the numbers (usually subscript) are independently and optionally changed. In some embodiments, a chemical modification pattern comprises a pattern selected from Table 3A-3E. In some embodiments, a chemical modification pattern comprises a pattern selected from Table 3B-3E. In some embodiments, a provided stereochemistry pattern comprises a pattern selected from Table 3A-3E. In some embodiments, a provided stereochemistry pattern comprises a pattern selected from Table 3B-3E. In some embodiments, a provided stereochemistry pattern comprises a pattern selected from Table 3A-3E, wherein the numbers (usually subscript) are independently and optionally changed. In some embodiments, a provided stereochemistry pattern comprises a pattern selected from Table 3B-3E, wherein the numbers (usually subscript) are independently and optionally changed.

In some embodiments, a chemical modification pattern is selected from Table 3. In some embodiments, a provided stereochemistry pattern is selected from Table 3. In some embodiments, a provided stereochemistry pattern is selected from Table 3, wherein the numbers (usually subscript) are independently and optionally changed. In some embodiments, a chemical modification pattern is selected from Table 3A-3E. In some embodiments, a chemical modification pattern is selected from Table 3B-3E. In some embodiments, a provided stereochemistry pattern is selected from Table 3A-3E. In some embodiments, a provided stereochemistry pattern is selected from Table 3B-3E. In some embodiments, a provided stereochemistry pattern is selected from Table 3A-3E, wherein the numbers (usually subscript) are independently and optionally changed. In some embodiments, a provided stereochemistry pattern is selected from Table 3B-3E, wherein the numbers (usually subscript) are independently and optionally changed.

In some embodiments, a chemical modification pattern is selected from Table 4. In some embodiments, a provided stereochemistry pattern is selected from Table 4. In some embodiments, a provided stereochemistry pattern is selected from Table 4, wherein the numbers (usually subscript) are independently and optionally changed. In some embodiments, a chemical modification pattern is selected from Table 4. In some embodiments, a provided stereochemistry pattern is selected from Table 4. In some embodiments, a provided stereochemistry pattern is selected from Table 4, wherein the numbers (usually subscript) are independently and optionally changed.

In some embodiments, a provided oligonucleotide composition is a chirally controlled oligonucleotide composition of an oligonucleotide listed in Tables 2-4. In some embodiments, a provided oligonucleotide composition is a chirally controlled oligonucleotide composition of an oligonucleotide listed in Table 2. In some embodiments, a provided oligonucleotide composition is a chirally controlled oligonucleotide composition of an oligonucleotide listed in Table 3. In some embodiments, a provided oligonucleotide composition is a chirally controlled oligonucleotide composition of an oligonucleotide listed in Table 4. In some embodiments, the present disclosure pertains to a composition or method related to any oligonucleotide listed in Tables 2-4. In some embodiments, the present disclosure pertains to a composition or method related to any oligonucleotide listed in Table 2. In some embodiments, the present disclosure pertains to a composition or method related to any oligonucleotide listed in Table 3. In some embodiments, the present disclosure pertains to a composition or method related to any oligonucleotide listed in Table 4. In some embodiments, an active compound is any oligonucleotide listed in Tables 2-4. In some embodiments, an active compound is any oligonucleotide listed in Table 2. In some embodiments, an active compound is any oligonucleotide listed in Table 3. In some embodiments, an active compound is any oligonucleotide listed in Table 4. In some embodiments, a provided composition comprises a predetermined level of an oligonucleotide listed in Tables 2-4. In some embodiments, a provided composition comprises a predetermined level of an oligonucleotide listed in Table 2. In some embodiments, a provided composition comprises a predetermined level of an oligonucleotide listed in Table 3. In some embodiments, a provided composition comprises a predetermined level of an oligonucleotide listed in Table 4. In some embodiments, example properties of provided oligonucleotides were demonstrated, e.g., in FIGS. 1 to 38, etc.

In some embodiments, a provided oligonucleotide composition is a chirally controlled oligonucleotide composition, wherein the sequence of the oligonucleotide comprises or consists of the sequence of an oligonucleotide listed in Tables 2-4. In some embodiments, a provided oligonucleotide composition is a chirally controlled oligonucleotide composition, wherein the sequence of the oligonucleotide comprises or consists of the sequence of an oligonucleotide listed in Table 2. In some embodiments, a provided oligonucleotide composition is a chirally controlled oligonucleotide composition, wherein the sequence of the oligonucleotide comprises or consists of the sequence of an oligonucleotide listed in Table 3. In some embodiments, a provided oligonucleotide composition is a chirally controlled oligonucleotide composition, wherein the sequence of the oligonucleotide comprises or consists of the sequence of an oligonucleotide listed in Table 4. In some embodiments, the present disclosure pertains to a composition or method related to any oligonucleotide, wherein the sequence of the oligonucleotide comprises or consists of the sequence of an oligonucleotide listed in Tables 2-4. In some embodiments, the present disclosure pertains to a composition or method related to any oligonucleotide, wherein the sequence of the oligonucleotide comprises or consists of the sequence of an oligonucleotide listed in Table 2. In some embodiments, the present disclosure pertains to a composition or method related to any oligonucleotide, wherein the sequence of the oligonucleotide comprises or consists of the sequence of an oligonucleotide listed in Table 3. In some embodiments, the present disclosure pertains to a composition or method related to any oligonucleotide, wherein the sequence of the oligonucleotide comprises or consists of the sequence of an oligonucleotide listed in Table 4. In some embodiments, an active compound is any oligonucleotide, wherein the sequence of the oligonucleotide comprises or consists of the sequence of an oligonucleotide listed in Tables 2-4. In some embodiments, an active compound is any oligonucleotide, wherein the sequence of the oligonucleotide comprises or consists of the sequence of an oligonucleotide listed in Table 2. In some embodiments, an active compound is any oligonucleotide, wherein the sequence of the oligonucleotide comprises or consists of the sequence of an oligonucleotide listed in Table 3. In some embodiments, an active compound is any oligonucleotide, wherein the sequence of the oligonucleotide comprises or consists of the sequence of an oligonucleotide listed in Table 4. In some embodiments, the sequence of an oligonucleotide includes any one or more of: base sequence (including length); pattern of chemical modifications to sugar and base moieties; pattern of backbone linkages; pattern of natural phosphate linkages, phosphorothioate linkages, phosphorothioate triester linkages, and combinations thereof; pattern of backbone chiral centers; pattern of stereochemistry (Rp/Sp) of chiral internucleotidic linkages; pattern of backbone phosphorus modifications; pattern of modifications on the internucleotidic phosphorus atom, such as —S—, and -L-$R^1$ of formula I.

In some embodiments, the present disclosure provides compositions comprising or consisting of a plurality of provided oligonucleotides (e.g., chirally controlled oligonucleotide compositions). In some embodiments, all such provided oligonucleotides are of the same type, i.e., all have the same base sequence, pattern of backbone linkages (i.e., pattern of internucleotidic linkage types, for example, phosphate, phosphorothioate, etc), pattern of backbone chiral centers (i.e. pattern of linkage phosphorus stereochemistry (Rp/Sp)), and pattern of backbone phosphorus modifications (e.g., pattern of "—$XLR^1$" groups in formula I). In some embodiments, all oligonucleotides of the same type are identical. In many embodiments, however, provided compositions comprise a plurality of oligonucleotides types, typically in pre-determined relative amounts.

In some embodiments, a provided chirally controlled oligonucleotide composition comprises a combination of one or more provided oligonucleotide types. One of skill in the chemical and medicinal arts will recognize that the selection and amount of each of the one or more types of provided oligonucleotides in a provided composition will depend on the intended use of that composition. That is to say, one of skill in the relevant arts would design a provided chirally controlled oligonucleotide composition such that the amounts and types of provided oligonucleotides contained therein cause the composition as a whole to have certain desirable characteristics (e.g., biologically desirable, therapeutically desirable, etc.).

In some embodiments, a provided chirally controlled oligonucleotide composition comprises a combination of two or more provided oligonucleotide types. In some embodiments, a provided chirally controlled oligonucleotide composition comprises a combination of three or more provided oligonucleotide types. In some embodiments, a provided chirally controlled oligonucleotide composition comprises a combination of four or more provided oligonucleotide types. In some embodiments, a provided chirally controlled oligonucleotide composition comprises a combination of five or more provided oligonucleotide types. In some embodiments, a provided chirally controlled oligonucleotide composition comprises a combination of six or more provided oligonucleotide types. In some embodiments, a provided chirally controlled oligonucleotide composition comprises a combination of seven or more provided oligonucleotide types. In some embodiments, a provided chirally controlled oligonucleotide composition comprises a combination of eight or more provided oligonucleotide types. In some embodiments, a provided chirally controlled oligonucleotide composition comprises a combination of nine or more provided oligonucleotide types. In some embodiments, a provided chirally controlled oligonucleotide composition comprises a combination of ten or more provided oligonucleotide types. In some embodiments, a provided chirally controlled oligonucleotide composition comprises a combination of fifteen or more provided oligonucleotide types.

In some embodiments, a provided chirally controlled oligonucleotide composition is a combination of an amount of chirally uniform mipomersen of the Rp configuration and an amount of chirally uniform mipomersen of the Sp configuration.

In some embodiments, a provided chirally controlled oligonucleotide composition is a combination of an amount of chirally uniform mipomersen of the Rp configuration, an amount of chirally uniform mipomersen of the Sp configuration, and an amount of one or more chirally pure mipomersen of a desired diastereomeric form.

In some embodiments, a provided oligonucleotide type is selected from those described in WO/2014/012081 and WO/2015/107425, the oligonucleotides, oligonucleotide types, oligonucleotide compositions, and methods thereof of each of which are incorporated herein by reference. In some embodiments, a provided chirally controlled oligonucleotide composition comprises oligonucleotides of an oligonucleotide type selected from those described in WO/2014/012081 and WO/2015/107425.

In some embodiments, the present disclosure pertains to a composition comprising a chirally controlled oligonucleotide composition, wherein the sequence of the oligonucleotide comprises or consists of the sequence of any chirally controlled oligonucleotide composition disclosed herein.

In some embodiments, the present disclosure pertains to a composition comprising a chirally controlled oligonucleotide composition, wherein the sequence of the oligonucleotide comprises or consists of the sequence of any chirally controlled oligonucleotide composition disclosed in Table 2-4. In some embodiments, the present disclosure pertains to a composition comprising a chirally controlled oligonucleotide composition, wherein the sequence of the oligonucleotide comprises or consists of the sequence of any chirally controlled oligonucleotide composition disclosed in Table 2. In some embodiments, the present disclosure pertains to a composition comprising a chirally controlled oligonucleotide composition, wherein the sequence of the oligonucleotide comprises or consists of the sequence of any chirally controlled oligonucleotide composition disclosed in Table 3. In some embodiments, the present disclosure pertains to a composition comprising a chirally controlled oligonucleotide composition, wherein the sequence of the oligonucleotide comprises or consists of the sequence of any chirally controlled oligonucleotide composition disclosed in Table 4.

In some embodiments, a provided oligonucleotide composition is a chirally controlled oligonucleotide composition, wherein the sequence of the oligonucleotide comprises or consists of the sequence of an oligonucleotide listed in Tables 2-4. In some embodiments, a provided oligonucleotide composition is a chirally controlled oligonucleotide composition, wherein the sequence of the oligonucleotide comprises or consists of the sequence of an oligonucleotide listed in Table 2. In some embodiments, a provided oligonucleotide composition is a chirally controlled oligonucleotide composition, wherein the sequence of the oligonucleotide comprises or consists of the sequence of an oligonucleotide listed in Table 3. In some embodiments, a provided oligonucleotide composition is a chirally controlled oligonucleotide composition, wherein the sequence of the oligonucleotide comprises or consists of the sequence of an oligonucleotide listed in Table 4. In some embodiments, the present disclosure pertains to a composition or method related to any oligonucleotide, wherein the sequence of the oligonucleotide comprises or consists of the sequence of an oligonucleotide listed in Tables 2-4. In some embodiments, the present disclosure pertains to a composition or method related to any oligonucleotide, wherein the sequence of the oligonucleotide comprises or consists of the sequence of an oligonucleotide listed in Table 2. In some embodiments, the present disclosure pertains to a composition or method related to any oligonucleotide, wherein the sequence of the oligonucleotide comprises or consists of the sequence of an oligonucleotide listed in Table 3. In some embodiments, the present disclosure pertains to a composition or method related to any oligonucleotide, wherein the sequence of the oligonucleotide comprises or consists of the sequence of an oligonucleotide listed in Table 4. In some embodiments, an active compound is any oligonucleotide, wherein the sequence of the oligonucleotide comprises or consists of the sequence of an oligonucleotide listed in Tables 2-4. In some embodiments, an active compound is any oligonucleotide, wherein the sequence of the oligonucleotide comprises or consists of the sequence of an oligonucleotide listed in Table 2. In some embodiments, an active compound is any oligonucleotide, wherein the sequence of the oligonucleotide comprises or consists of the sequence of an oligonucleotide listed in Table 3. In some embodiments, an active compound is any oligonucleotide, wherein the sequence of the oligonucleotide comprises or consists of the sequence of an oligonucleotide listed in Table 4. In some embodiments, the sequence of an oligonucleotide includes any one or more of: base sequence (including length); pattern of chemical modifications to sugar and base moieties; pattern of backbone linkages; pattern of natural phosphate linkages, phosphorothioate linkages, phosphorothioate triester linkages, and combinations thereof; pattern of backbone chiral centers; pattern of stereochemistry (Rp/Sp) of chiral internucleotidic linkages; pattern of backbone phosphorus modifications; pattern of modifications on the internucleotidic phosphorus atom, such as —S—, and -L-$R^1$ of formula I.

In some experiments, provided oligonucleotides provided surprisingly high activities, e.g., when compared to those of Drisapersen and/or Eteplirsen. For example, chirally controlled oligonucleotide compositions of WV-887, WV-892, WV-896, WV-1714, WV-2444, WV-2445, WV-2526, WV-2527, WV-2528, and WV-2530, and many others, each showed a superior capability, in some embodiments many fold higher, to mediate skipping of an exon in dystrophin, compared to Drisapersen and/or Eteplirsen, as demonstrated in the present disclosure, e.g., in various Figures, etc.

In some embodiments, the present disclosure pertains to a composition comprising a chirally controlled oligonucleotide composition selected from: WV-887, WV-892, WV-896, WV-1714, WV-2444, WV-2445, WV-2526, WV-2527, WV-2528, WV-2530, WV-2531, WV-2578, WV-2580, WV-2587, WV-3047, WV-3152, WV-3472, WV-3473, WV-3507, WV-3508, WV-3509, WV-3510, WV-3511, WV-3512, WV-3513, WV-3514, WV-3515, WV-3545, and WV-3546. In some embodiments, the present disclosure pertains to a composition comprising a chirally controlled oligonucleotide composition wherein the sequence of the oligonucleotide comprises or consists of the sequence of an oligonucleotide selected from: WV-887, WV-892, WV-896, WV-1714, WV-2444, WV-2445, WV-2526, WV-2527, WV-2528, WV-2530, WV-2531, WV-2578, WV-2580, WV-2587, WV-3047, WV-3152, WV-3472, WV-3473, WV-3507, WV-3508, WV-3509, WV-3510, WV-3511, WV-3512, WV-3513, WV-3514, WV-3515, WV-3545, and WV-3546.

In some embodiments, the present disclosure pertains to a chirally controlled oligonucleotide composition, wherein the sequence of the oligonucleotide comprises the sequence of WV-887. In some embodiments, the present disclosure pertains to a chirally controlled oligonucleotide composition, wherein the sequence of the oligonucleotide comprises the sequence of WV-892. In some embodiments, the present disclosure pertains to a chirally controlled oligonucleotide composition, wherein the sequence of the oligonucleotide comprises the sequence of WV-896. In some embodiments, the present disclosure pertains to a chirally controlled oligonucleotide composition, wherein the sequence of the oligonucleotide comprises the sequence of WV-1714. In some embodiments, the present disclosure pertains to a chirally controlled oligonucleotide composition, wherein the sequence of the oligonucleotide comprises the sequence of WV-2444. In some embodiments, the present disclosure pertains to a chirally controlled oligonucleotide composition, wherein the sequence of the oligonucleotide comprises the sequence of WV-2445. In some embodiments, the present disclosure pertains to a chirally controlled oligonucleotide composition, wherein the sequence of the oligonucleotide comprises the sequence of WV-2526. In some embodiments, the present disclosure pertains to a chirally controlled oligonucleotide composition, wherein the sequence of the oligonucleotide comprises the sequence of WV-2527. In some embodiments, the present disclosure pertains to a chirally controlled oligonucleotide composition, wherein the sequence of the oligonucleotide comprises the sequence of WV-2528. In some embodiments, the present disclosure pertains to a chirally controlled oligonucleotide composition, wherein the sequence of the oligonucleotide comprises the sequence of WV-2530. In some embodiments, the present disclosure pertains to a chirally controlled oligonucleotide composition, wherein the sequence of the oligonucleotide comprises the sequence of WV-2531. In some embodiments, the present disclosure pertains to a chirally controlled oligonucleotide composition, wherein the sequence of the oligonucleotide comprises the sequence of WV-2578. In some embodiments, the present disclosure pertains to a chirally controlled oligonucleotide composition, wherein the sequence of the oligonucleotide comprises the sequence of WV-2580. In some embodiments, the present disclosure pertains to a chirally controlled oligonucleotide composition, wherein the sequence of the oligonucleotide comprises the sequence of WV-2587. In some embodiments, the present disclosure pertains to a chirally controlled oligonucleotide composition, wherein the sequence of the oligonucleotide comprises the sequence of WV-3047. In some embodiments, the present disclosure pertains to a chirally controlled oligonucleotide composition, wherein the sequence of the oligonucleotide comprises the sequence of WV-3152. In some embodiments, the present disclosure pertains to a chirally controlled oligonucleotide composition, wherein the sequence of the oligonucleotide comprises the sequence of WV-3472. In some embodiments, the present disclosure pertains to a chirally controlled oligonucleotide composition, wherein the sequence of the oligonucleotide comprises the sequence of WV-3473. In some embodiments, the present disclosure pertains to a chirally controlled oligonucleotide composition, wherein the sequence of the oligonucleotide comprises the sequence of WV-3507. In some embodiments, the present disclosure pertains to a chirally controlled oligonucleotide composition, wherein the sequence of the oligonucleotide comprises the sequence of WV-3508. In some embodiments, the present disclosure pertains to a chirally controlled oligonucleotide composition, wherein the sequence of the oligonucleotide comprises the sequence of WV-3509. In some embodiments, the present disclosure pertains to a chirally controlled oligonucleotide composition, wherein the sequence of the oligonucleotide comprises the sequence of WV-3510. In some embodiments, the present disclosure pertains to a chirally controlled oligonucleotide composition, wherein the sequence of the oligonucleotide comprises the sequence of WV-3511. In some embodiments, the present disclosure pertains to a chirally controlled oligonucleotide composition, wherein the sequence of the oligonucleotide comprises the sequence of WV-3512. In some embodiments, the present disclosure pertains to a chirally controlled oligonucleotide composition, wherein the sequence of the oligonucleotide comprises the sequence of WV-3513. In some embodiments, the present disclosure pertains to a chirally controlled oligonucleotide composition, wherein the sequence of the oligonucleotide comprises the sequence of WV-3514. In some embodiments, the present disclosure pertains to a chirally controlled oligonucleotide composition, wherein the sequence of the oligonucleotide comprises the sequence of WV-3515. In some embodiments, the present disclosure pertains to a chirally controlled oligonucleotide composition, wherein the sequence of the oligonucleotide comprises the sequence of WV-3545. In some embodiments, the present disclosure pertains to a chirally controlled oligonucleotide composition, wherein the sequence of the oligonucleotide comprises the sequence of WV-3546.

In some embodiments, the oligonucleotide is no more than 25 bases long. In some embodiments, the oligonucleotide is no more than 30 bases long. In some embodiments, the oligonucleotide is no more than 35 bases long. In some embodiments, the oligonucleotide is no more than 40 bases long. In some embodiments, the oligonucleotide is no more than 45 bases long. In some embodiments, the oligonucleotide is no more than 50 bases long. In some embodiments, the oligonucleotide is no more than 55 bases long. In some embodiments, the oligonucleotide is no more than 60 bases long.

In some embodiments, the present disclosure pertains to a chirally controlled oligonucleotide composition, wherein the sequence of the oligonucleotide consists of the sequence of WV-887. In some embodiments, the present disclosure pertains to a chirally controlled oligonucleotide composition, wherein the sequence of the oligonucleotide consists of the sequence of WV-892. In some embodiments, the present disclosure pertains to a chirally controlled oligonucleotide composition, wherein the sequence of the oligonucleotide consists of the sequence of WV-896. In some embodiments, the present disclosure pertains to a chirally controlled oligonucleotide composition, wherein the sequence of the oligonucleotide consists of the sequence of WV-1714. In some embodiments, the present disclosure pertains to a chirally controlled oligonucleotide composition, wherein the sequence of the oligonucleotide consists of the sequence of WV-2444. In some embodiments, the present disclosure pertains to a chirally controlled oligonucleotide composition, wherein the sequence of the oligonucleotide consists of the sequence of WV-2445. In some embodiments, the present disclosure pertains to a chirally controlled oligonucleotide composition, wherein the sequence of the oligonucleotide consists of the sequence of WV-2526. In some embodiments, the present disclosure pertains to a chirally controlled oligonucleotide composition, wherein the sequence of the oligonucleotide consists of the sequence of WV-2527. In some embodiments, the present disclosure pertains to a chirally controlled oligonucleotide composition, wherein the sequence of the oligonucleotide consists of the sequence of WV-2528. In some embodiments, the present disclosure pertains to a chirally controlled oligonucleotide composition, wherein the sequence of the oligonucleotide consists of the sequence of WV-2530. In some embodiments, the present disclosure pertains to a chirally controlled oligonucleotide composition, wherein the sequence of the oligonucleotide consists of the sequence of WV-2531. In some embodiments, the present disclosure pertains to a chirally controlled oligonucleotide composition, wherein the sequence of the oligonucleotide consists of the sequence of WV-2578. In some embodiments, the present disclosure pertains to a chirally controlled oligonucleotide composition, wherein the sequence of the oligonucleotide consists of the sequence of WV-2580. In some embodiments, the present disclosure pertains to a chirally controlled oligonucleotide composition, wherein the sequence of the oligonucleotide consists of the sequence of WV-2587. In some embodiments, the present disclosure pertains to a chirally controlled oligonucleotide composition, wherein the sequence of the oligonucleotide consists of the sequence of WV-3047. In some embodiments, the present disclosure pertains to a chirally controlled oligonucleotide composition, wherein the sequence of the oligonucleotide consists of the sequence of WV-3152. In some embodiments, the present disclosure pertains to a chirally controlled oligonucleotide composition, wherein the sequence of the oligonucleotide consists of the sequence of WV-3472. In some embodiments, the present disclosure pertains to a chirally controlled oligonucleotide composition, wherein the sequence of the oligonucleotide consists of the sequence of WV-3473. In some embodiments, the present disclosure pertains to a chirally controlled oligonucleotide composition, wherein the sequence of the oligonucleotide consists of the sequence of WV-3507. In some embodiments, the present disclosure pertains to a chirally controlled oligonucleotide composition, wherein the sequence of the oligonucleotide consists of the sequence of WV-3508. In some embodiments, the present disclosure pertains to a chirally controlled oligonucleotide composition, wherein the sequence of the oligonucleotide consists of the sequence of WV-3509. In some embodiments, the present disclosure pertains to a chirally controlled oligonucleotide composition, wherein the sequence of the oligonucleotide consists of the sequence of WV-3510. In some embodiments, the present disclosure pertains to a chirally controlled oligonucleotide composition, wherein the sequence of the oligonucleotide consists of the sequence of WV-3511. In some embodiments, the present disclosure pertains to a chirally controlled oligonucleotide composition, wherein the sequence of the oligonucleotide consists of the sequence of WV-3512. In some embodiments, the present disclosure pertains to a chirally controlled oligonucleotide composition, wherein the sequence of the oligonucleotide consists of the sequence of WV-3513. In some embodiments, the present disclosure pertains to a chirally controlled oligonucleotide composition, wherein the sequence of the oligonucleotide consists of the sequence of WV-3514. In some embodiments, the present disclosure pertains to a chirally controlled oligonucleotide composition, wherein the sequence of the oligonucleotide consists of the sequence of WV-3515. In some embodiments, the present disclosure pertains to a chirally controlled oligonucleotide composition, wherein the sequence of the oligonucleotide consists of the sequence of WV-3545. In some embodiments, the present disclosure pertains to a chirally controlled oligonucleotide composition, wherein the sequence of the oligonucleotide consists of the sequence of WV-3546.

In some embodiments, the present disclosure pertains to a chirally controlled oligonucleotide composition, wherein the sequence of the oligonucleotide comprises or consists of the sequence of WV-887, wherein the composition further comprises a lipid. In some embodiments, the present disclosure pertains to a chirally controlled oligonucleotide composition, wherein the sequence of the oligonucleotide comprises or consists of the sequence of WV-892, wherein the composition further comprises a lipid. In some embodiments, the present disclosure pertains to a chirally controlled oligonucleotide composition, wherein the sequence of the oligonucleotide comprises or consists of the sequence of WV-896, wherein the composition further comprises a lipid. In some embodiments, the present disclosure pertains to a chirally controlled oligonucleotide composition, wherein the sequence of the oligonucleotide comprises or consists of the sequence of WV-1714, wherein the composition further comprises a lipid. In some embodiments, the present disclosure pertains to a chirally controlled oligonucleotide composition, wherein the sequence of the oligonucleotide comprises or consists of the sequence of WV-2444, wherein the composition further comprises a lipid. In some embodiments, the present disclosure pertains to a chirally controlled oligonucleotide composition, wherein the sequence of the oligonucleotide comprises or consists of the sequence of WV-2445, wherein the composition further comprises a lipid. In some embodiments, the present disclosure pertains to a chirally controlled oligonucleotide composition, wherein the sequence of the oligonucleotide comprises or consists of the sequence of WV-2526, wherein the composition further comprises a lipid. In some embodiments, the present disclosure pertains to a chirally controlled oligonucleotide composition, wherein the sequence of the oligonucleotide comprises or consists of the sequence of WV-2527, wherein the composition further comprises a lipid. In some embodiments, the present disclosure pertains to a chirally controlled oligonucleotide composition, wherein the sequence of the oligonucleotide comprises or consists of the sequence of WV-2528, wherein the composition further comprises a lipid. In some embodiments, the present disclosure pertains to a chirally controlled oligonucleotide composition, wherein the sequence of the oligonucleotide comprises or consists of the sequence of WV-2530, wherein the composition further comprises a lipid. In some embodiments, the present disclosure pertains to a chirally controlled oligonucleotide composition, wherein the sequence of the oligonucleotide comprises or consists of the sequence of WV-2531, wherein the composition further comprises a lipid. In some embodiments, the present disclosure pertains to a chirally controlled oligonucleotide composition, wherein the sequence of the oligonucleotide comprises or consists of the sequence of WV-2578, wherein the composition further comprises a lipid. In some embodiments, the present disclosure pertains to a chirally controlled oligonucleotide composition, wherein the sequence of the oligonucleotide comprises or consists of the sequence of WV-2580, wherein the composition further comprises a lipid. In some embodiments, the present disclosure pertains to a chirally controlled oligonucleotide composition, wherein the sequence of the oligonucleotide comprises or consists of the sequence of WV-2587, wherein the composition further comprises a lipid. In some embodiments, the present disclosure pertains to a chirally controlled oligonucleotide composition, wherein the sequence of the oligonucleotide comprises or consists of the sequence of WV-3047, wherein the composition further comprises a lipid. In some embodiments, the present disclosure pertains to a chirally controlled oligonucleotide composition, wherein the sequence of the oligonucleotide comprises or consists of the sequence of WV-3152, wherein the composition further comprises a lipid. In some embodiments, the present disclosure pertains to a chirally controlled oligonucleotide composition, wherein the sequence of the oligonucleotide comprises or consists of the sequence of WV-3472, wherein the composition further comprises a lipid. In some embodiments, the present disclosure pertains to a chirally controlled oligonucleotide composition, wherein the sequence of the oligonucleotide comprises or consists of the sequence of WV-3473, wherein the composition further comprises a lipid. In some embodiments, the present disclosure pertains to a chirally controlled oligonucleotide composition, wherein the sequence of the oligonucleotide comprises or consists of the sequence of WV-3507, wherein the composition further comprises a lipid. In some embodiments, the present disclosure pertains to a chirally controlled oligonucleotide composition, wherein the sequence of the oligonucleotide comprises or consists of the sequence of WV-3508, wherein the composition further comprises a lipid. In some embodiments, the present disclosure pertains to a chirally controlled oligonucleotide composition, wherein the sequence of the oligonucleotide comprises or consists of the sequence of WV-3509, wherein the composition further comprises a lipid. In some embodiments, the present disclosure pertains to a chirally controlled oligonucleotide composition, wherein the sequence of the oligonucleotide comprises or consists of the sequence of WV-3510, wherein the composition further comprises a lipid. In some embodiments, the present disclosure pertains to a chirally controlled oligonucleotide composition, wherein the sequence of the oligonucleotide comprises or consists of the sequence of WV-3511, wherein the composition further comprises a lipid. In some embodiments, the present disclosure pertains to a chirally controlled oligonucleotide composition, wherein the sequence of the oligonucleotide comprises or consists of the sequence of WV-3512, wherein the composition further comprises a lipid. In some embodiments, the present disclosure pertains to a chirally controlled oligonucleotide composition, wherein the sequence of the oligonucleotide comprises or consists of the sequence of WV-3513, wherein the composition further comprises a lipid. In some embodiments, the present disclosure pertains to a chirally controlled oligonucleotide composition, wherein the sequence of the oligonucleotide comprises or consists of the sequence of WV-3514, wherein the composition further comprises a lipid. In some embodiments, the present disclosure pertains to a chirally controlled oligonucleotide composition, wherein the sequence of the oligonucleotide comprises or consists of the sequence of WV-3515, wherein the composition further comprises a lipid. In some embodiments, a lipid is stearic acid or turbinaric acid. In some embodiments, a lipid is conjugated to the oligonucleotide.

In some embodiments, conjugation of a lipid to an oligonucleotide improves at least one property of the oligonucleotide. In some embodiments, the property is increased activity (e.g., increased ability to induce desirable skipping of a deleterious exon), decreased toxicity, or improved distribution to a tissue. In some embodiments, lipid conjugation improves activity. In some embodiments, lipid conjugation decreases toxicity. In some embodiments, lipid conjugation decreases hTLR9 agonist activity. In some embodiments, lipid conjugation increases hTLR9 antagonist activity. In some embodiments, lipid conjugation improves deliveries to one or more target tissues. In some embodiments, the tissue is muscle tissue. In some embodiments, the tissue is skeletal muscle, gastroenemius, triceps, heart or diaphragm.

In some embodiments, a provided oligonucleotide is no more than 25 bases long. In some embodiments, a provided oligonucleotide is no more than 30 bases long. In some embodiments, a provided oligonucleotide is no more than 35 bases long. In some embodiments, a provided oligonucleotide is no more than 40 bases long. In some embodiments, a provided oligonucleotide is no more than 45 bases long. In some embodiments, a provided oligonucleotide is no more than 50 bases long. In some embodiments, a provided oligonucleotide is no more than 55 bases long. In some embodiments, a provided oligonucleotide is no more than 60 bases long. In some embodiments, a U is replaced with T, or vice versa.

In some embodiments, a lipid comprises an optionally substituted, $C_{10}$-$C_{80}$ saturated or partially unsaturated aliphatic group, wherein one or more methylene units are optionally and independently replaced by an optionally substituted group selected from $C_1$-$C_6$ alkylene, $C_1$-$C_6$ alkenylene, —C≡C—, a $C_1$-$C_6$ heteroaliphatic moiety, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, and —C(O)O—, wherein each variable is independently as defined and described herein. In some embodiments, a lipid comprises an optionally substituted $C_{10}$-$C_{60}$ saturated or partially unsaturated, aliphatic chain. In some embodiments, a lipid comprises an optionally substituted $C_{10}$-$C_{60}$ linear, saturated or partially unsaturated, aliphatic chain. In some embodiments, a lipid comprises a $C_{10}$-$C_{60}$ linear, saturated or partially unsaturated, aliphatic chain, optionally substituted with one or more $C_{1-4}$ aliphatic group. In some embodiments, a lipid comprises an optionally substituted, $C_{10}$-$C_{60}$ saturated or partially unsaturated aliphatic group, wherein one or more methylene units are optionally and independently replaced by an optionally substituted group selected from $C_1$-$C_6$ alkylene, $C_1$-$C_6$ alkenylene, —C≡C—, a $C_1$-$C_6$ heteroaliphatic moiety, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, and —C(O)O—, wherein each variable is independently as defined and described herein. In some embodiments, a lipid comprises an optionally substituted $C_{10}$-$C_{60}$ saturated or partially unsaturated, aliphatic chain. In some embodiments, a lipid comprises an optionally substituted $C_{10}$-$C_{60}$ linear, saturated or partially unsaturated, aliphatic chain. In some embodiments, a lipid comprises a $C_{10}$-$C_{60}$ linear, saturated or partially unsaturated, aliphatic chain, optionally substituted with one or more $C_{1-4}$ aliphatic group. In some embodiments, a lipid comprises an optionally substituted, $C_{10}$-$C_{40}$ saturated or partially unsaturated aliphatic group, wherein one or more methylene units are optionally and independently replaced by an optionally substituted group selected from $C_1$-$C_6$ alkylene, $C_1$-$C_6$ alkenylene, —C≡C—, a $C_1$-$C_6$ heteroaliphatic moiety, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, and —C(O)O—, wherein each variable is independently as defined and described herein. In some embodiments, a lipid comprises an optionally substituted $C_{10}$-$C_{60}$ saturated or partially unsaturated, aliphatic chain. In some embodiments, a lipid comprises an optionally substituted $C_{10}$-$C_{60}$ linear, saturated or partially unsaturated, aliphatic chain. In some embodiments, a lipid comprises a $C_{10}$-$C_{60}$ linear, saturated or partially unsaturated, aliphatic chain, optionally substituted with one or more $C_{1-4}$ aliphatic group. In some embodiments, a lipid comprises an unsubstituted $C_{10}$-$C_{80}$ linear, saturated or partially unsaturated, aliphatic chain. In some embodiments, a lipid comprises no more than one optionally substituted $C_{10}$-$C_{60}$ linear, saturated or partially unsaturated, aliphatic chain. In some embodiments, a lipid comprises two or more optionally substituted $C_{10}$-$C_{60}$ linear, saturated or partially unsaturated, aliphatic chain. In some embodiments, a lipid comprises an unsubstituted $C_{10}$-$C_{60}$ linear, saturated or partially unsaturated, aliphatic chain. In some embodiments, a lipid comprises no more than one optionally substituted $C_{10}$-$C_{60}$ linear, saturated or partially unsaturated, aliphatic chain. In some embodiments, a lipid comprises two or more optionally substituted $C_{10}$-$C_{60}$ linear, saturated or partially unsaturated, aliphatic chain. In some embodiments, a lipid comprises an unsubstituted $C_{10}$-$C_{40}$ linear, saturated or partially unsaturated, aliphatic chain. In some embodiments, a lipid comprises no more than one optionally substituted $C_{10}$-$C_{60}$ linear, saturated or partially unsaturated, aliphatic chain. In some embodiments, a lipid comprises two or more optionally substituted $C_{10}$-$C_{60}$ linear, saturated or partially unsaturated, aliphatic chain. In some embodiments, a lipid comprises a $C_{10}$-$C_{40}$ linear, saturated or partially unsaturated, aliphatic chain. In some embodiments, a lipid comprises a $C_{10}$-$C_{40}$ linear, saturated or partially unsaturated, aliphatic chain, optionally substituted with one or more $C_{1-4}$ aliphatic group. In various embodiments, the lipid is selected from the group consisting of: lauric acid, myristic acid, palmitic acid, stearic acid, oleic acid, linoleic acid, alpha-linolenic acid, gamma-linolenic acid, docosahexaenoic acid (cis-DHA), turbinaric acid and dilinoleyl. In some embodiments, the lipid is not conjugated to the oligonucleotide. In some embodiments, the lipid is conjugated to the oligonucleotide.

In some embodiments, conjugation of a lipid to an oligonucleotide surprisingly improves at least one property of the oligonucleotide. In some embodiments, the property is increased activity (e.g., increased ability to induce desirable skipping of a deleterious exon), decreased toxicity, or improved distribution to a tissue. In some embodiments, the tissue is muscle tissue. In some embodiments, the tissue is skeletal muscle, gastrocnemius, triceps, heart or diaphragm. In some embodiments, oligonucleotides comprising lipid moieties form, for example, micelles. In some embodiments, example improved properties are demonstrated, e.g., in one or more of the Figures.

In some embodiments, when assaying example oligonucleotides in mice, tested oligonucleotides (e.g., WV-3473, WV-3545, WV-3546, WV-942, etc.) are intravenous injected via tail vein in male $C_{57}$BL/10ScSndmdmdx mice (4-5 weeks old), at tested amounts, e.g., 10 mg/kg, 30 mg/kg, etc. In some embodiments, tissues are harvested at tested times, e.g., on Day, e.g., 2, 7 and/or 14, etc., after injection, in some embodiments, fresh-frozen in liquid nitrogen and stored in −80° C. until analysis.

Various assays can be used to assess oligonucleotide levels in accordance with the present disclosure. In some embodiments, hybrid-ELISA is used to quantify oligonucleotide levels in tissues using test article serial dilution as standard curve: for example, in an example procedure, maleic anhydride activated 96 well plate (Pierce 15110) was coated with 50 μl of capture probe at 500 nM in 2.5% $NaHCO_3$(Gibco, 25080-094) for 2 hours at 37° C. The plate was then washed 3 times with PBST (PBS+0.1% Tween-20), and blocked with 5% fat free milk-PBST at 37° C. for 1 hour. Test article oligonucleotide was serial diluted into matrix. This standard together with original samples were diluted with lysis buffer (4 M Guanidine; 0.33% N-Lauryl Sarcosine; 25 mM Sodium Citrate; 10 mM DTT) so that oligonucleotide amount in all samples is less than 100 ng/mL. 20 μl of diluted samples were mixed with 180 μl of 333 nM detection probe diluted in PBST, then denatured in PCR machine (65° C., 10 min, 95° C., 15 min, 4 C ∞). 50 μl of denatured samples were distributed in blocked ELISA plate in triplicates, and incubated overnight at 4° C. After 3 washes of PBST, 1:2000 streptavidin-AP in PBST was added, 50 μl per well and incubated at room temperature for 1 hour. After extensive wash with PBST, 100 μl of AttoPhos (Promega S1000) was added, incubated at room temperature in dark for 10 min and read on plate reader (Molecular Device, M5) fluorescence channel: Ex435 nm, Em555 nm. Oligonucleotides in samples were calculated according to standard curve by 4-parameter regression.

As described and demonstrated in the present disclosure, in some embodiments, lipid conjugation improves delivery to a tissue. In some embodiments, lipid conjugation improves delivery to muscle. In some embodiments, lipid conjugation comprises conjugation with a fatty acid. In some embodiments, oligonucleotides are conjugated with turbinaric acid. In some embodiments, conjugation with turbinaric acid is particularly effective in improving oligonucleotide delivery to muscle.

In some embodiments, provided oligonucleotides, e.g., WV-3473, are stable in both plasma and tissue homogenates.

Example Methods for Preparing Oligonucleotides and Compositions

Methods for preparing provided oligonucleotides and oligonucleotide compositions are widely known in the art, including but not limited to those described in WO/2010/064146, WO/2011/005761, WO/2013/012758, WO/2014/010250, US2013/0178612, WO/2014/012081, WO/2015/107425, PCT/US2016/043542, and PCT/US2016/043598, the methods and reagents of each of which is incorporated herein by reference.

Among other things, the present disclosure provides methods for making chirally controlled oligonucleotides and chirally controlled compositions comprising one or more specific nucleotide types. In some embodiments, the phrase "oligonucleotide type," as used herein, defines an oligonucleotide that has a particular base sequence, pattern of backbone linkages, pattern of backbone chiral centers, and pattern of backbone phosphorus modifications (e.g., "—$XLR^1$" groups). Oligonucleotides of a common designated "type" are structurally identical to one another with respect to base sequence, pattern of backbone linkages, pattern of backbone chiral centers, and pattern of backbone phosphorus modifications. In some embodiments, oligonucleotides of an oligonucleotide type are identical.

In some embodiments, a provided chirally controlled oligonucleotide in the disclosure has properties different from those of the corresponding stereorandom oligonucleotide mixture. In some embodiments, a chirally controlled oligonucleotide has lipophilicity different from that of the stereorandom oligonucleotide mixture. In some embodiments, a chirally controlled oligonucleotide has different retention time on HPLC. In some embodiments, a chirally controlled oligonucleotide may have a peak retention time significantly different from that of the corresponding stereorandom oligonucleotide mixture. During oligonucleotide purification using HPLC as generally practiced in the art, certain chirally controlled oligonucleotides will be largely if not totally lost. During oligonucleotide purification using HPLC as generally practiced in the art, certain chirally controlled oligonucleotides will be largely if not totally lost. One of the consequences is that certain diastereomers of a stereorandom oligonucleotide mixture (certain chirally controlled oligonucleotides) are not tested in assays. Another consequence is that from batches to batches, due to the inevitable instrumental and human errors, the supposedly "pure" stereorandom oligonucleotide will have inconsistent compositions in that diastereomers in the composition, and their relative and absolute amounts, are different from batches to batches. The chirally controlled oligonucleotide and chirally controlled oligonucleotide composition provided in this disclosure overcome such problems, as a chirally controlled oligonucleotide is synthesized in a chirally controlled fashion as a single diastereomer, and a chirally controlled oligonucleotide composition comprise predetermined levels of one or more individual oligonucleotide types.

One of skill in the chemical and synthetic arts will appreciate that synthetic methods of the present disclosure provide for a degree of control during each step of the synthesis of a provided oligonucleotide such that each nucleotide unit of the oligonucleotide can be designed and/or selected in advance to have a particular stereochemistry at the linkage phosphorus and/or a particular modification at the linkage phosphorus, and/or a particular base, and/or a particular sugar. In some embodiments, a provided oligonucleotide is designed and/or selected in advance to have a particular combination of stereocenters at the linkage phosphorus of the internucleotidic linkage.

In some embodiments, a provided oligonucleotide made using methods of the present disclosure is designed and/or determined to have a particular combination of linkage phosphorus modifications. In some embodiments, a provided oligonucleotide made using methods of the present disclosure is designed and/or determined to have a particular combination of bases. In some embodiments, a provided oligonucleotide made using methods of the present disclosure is designed and/or determined to have a particular combination of sugars. In some embodiments, a provided oligonucleotide made using methods of the present disclosure is designed and/or determined to have a particular combination of one or more of the above structural characteristics.

Methods of the present disclosure exhibit a high degree of chiral control. For instance, methods of the present disclosure facilitate control of the stereochemical configuration of every single linkage phosphorus within a provided oligonucleotide. In some embodiments, methods of the present disclosure provide an oligonucleotide comprising one or more modified internucleotidic linkages independently having the structure of formula I.

In some embodiments, methods of the present disclosure provide an oligonucleotide which is a mipomersen unimer. In some embodiments, methods of the present disclosure provide an oligonucleotide which is a mipomersen unimer of configuration Rp. In some embodiments, methods of the present disclosure provide an oligonucleotide which is a mipomersen unimer of configuration Sp.

In some embodiments, methods of the present disclosure provide a chirally controlled oligonucleotide composition, i.e., an oligonucleotide composition that contains predetermined levels of individual oligonucleotide types. In some embodiments a chirally controlled oligonucleotide composition comprises one oligonucleotide type. In some embodiments, a chirally controlled oligonucleotide composition comprises more than one oligonucleotide type. In some embodiments, a chirally controlled oligonucleotide composition comprises a plurality of oligonucleotide types. Example chirally controlled oligonucleotide compositions made in accordance with the present disclosure are described herein.

In some embodiments, methods of the present disclosure provide chirally pure mipomersen compositions with respect to the configuration of the linkage phosphorus. That is to say, in some embodiments, methods of the present disclosure provide compositions of mipomersen wherein mipomersen exists in the composition in the form of a single diastereomer with respect to the configuration of the linkage phosphorus.

In some embodiments, methods of the present disclosure provide chirally uniform mipomersen compositions with respect to the configuration of the linkage phosphorus. That is to say, in some embodiments, methods of the present disclosure provide compositions of mipomersen in which all nucleotide units therein have the same stereochemistry with respect to the configuration of the linkage phosphorus, e.g., all nucleotide units are of the Rp configuration at the linkage phosphorus or all nucleotide units are of the Sp configuration at the linkage phosphorus.

In some embodiments, a provided chirally controlled oligonucleotide is over 50% pure. In some embodiments, a provided chirally controlled oligonucleotide is over about 55% pure. In some embodiments, a provided chirally controlled oligonucleotide is over about 60% pure. In some embodiments, a provided chirally controlled oligonucleotide is over about 65% pure. In some embodiments, a provided chirally controlled oligonucleotide is over about 70% pure. In some embodiments, a provided chirally controlled oligonucleotide is over about 75% pure. In some embodiments, a provided chirally controlled oligonucleotide is over about 80% pure. In some embodiments, a provided chirally controlled oligonucleotide is over about 85% pure. In some embodiments, a provided chirally controlled oligonucleotide is over about 90% pure. In some embodiments, a provided chirally controlled oligonucleotide is over about 91% pure. In some embodiments, a provided chirally controlled oligonucleotide is over about 92% pure. In some embodiments, a provided chirally controlled oligonucleotide is over about 93% pure. In some embodiments, a provided chirally controlled oligonucleotide is over about 94% pure. In some embodiments, a provided chirally controlled oligonucleotide is over about 95% pure. In some embodiments, a provided chirally controlled oligonucleotide is over about 96% pure. In some embodiments, a provided chirally controlled oligonucleotide is over about 97% pure. In some embodiments, a provided chirally controlled oligonucleotide is over about 98% pure. In some embodiments, a provided chirally controlled oligonucleotide is over about 99% pure. In some embodiments, a provided chirally controlled oligonucleotide is over about 99.5% pure. In some embodiments, a provided chirally controlled oligonucleotide is over about 99.6% pure. In some embodiments, a provided chirally controlled oligonucleotide is over about 99.7% pure. In some embodiments, a provided chirally controlled oligonucleotide is over about 99.8% pure. In some embodiments, a provided chirally controlled oligonucleotide is over about 99.9% pure. In some embodiments, a provided chirally controlled oligonucleotide is over at least about 99% pure.

In some embodiments, a chirally controlled oligonucleotide composition is a composition designed to comprise a single oligonucleotide type. In certain embodiments, such compositions are about 50% diastereomerically pure. In some embodiments, such compositions are about 50% diastereomerically pure. In some embodiments, such compositions are about 50% diastereomerically pure. In some embodiments, such compositions are about 55% diastereomerically pure. In some embodiments, such compositions are about 60% diastereomerically pure. In some embodiments, such compositions are about 65% diastereomerically pure. In some embodiments, such compositions are about 70% diastereomerically pure. In some embodiments, such compositions are about 75% diastereomerically pure. In some embodiments, such compositions are about 80% diastereomerically pure. In some embodiments, such compositions are about 85% diastereomerically pure. In some embodiments, such compositions are about 90% diastereomerically pure. In some embodiments, such compositions are about 91% diastereomerically pure. In some embodiments, such compositions are about 92% diastereomerically pure. In some embodiments, such compositions are about 93% diastereomerically pure. In some embodiments, such compositions are about 94% diastereomerically pure. In some embodiments, such compositions are about 95% diastereomerically pure. In some embodiments, such compositions are about 96% diastereomerically pure. In some embodiments, such compositions are about 97% diastereomerically pure. In some embodiments, such compositions are about 98% diastereomerically pure. In some embodiments, such compositions are about 99% diastereomerically pure. In some embodiments, such compositions are about 99.5% diastereomerically pure. In some embodiments, such compositions are about 99.6% diastereomerically pure. In some embodiments, such compositions are about 99.7% diastereomerically pure. In some embodiments, such compositions are about 99.8% diastereomerically pure. In some embodiments, such compositions are about 99.9% diastereomerically pure. In some embodiments, such compositions are at least about 99% diastereomerically pure.

Among other things, the present disclosure recognizes the challenge of stereoselective (rather than stereorandom or racemic) preparation of oligonucleotides. Among other things, the present disclosure provides methods and reagents for stereoselective preparation of oligonucleotides comprising multiple (e.g., more than 5, 6, 7, 8, 9, or 10) internucleotidic linkages, and particularly for oligonucleotides comprising multiple (e.g., more than 5, 6, 7, 8, 9, or 10) chiral internucleotidic linkages. In some embodiments, in a stereorandom or racemic preparation of oligonucleotides, at least one chiral internucleotidic linkage is formed with less than 90:10, 95:5, 96:4, 97:3, or 98:2 diastereoselectivity. In some embodiments, for a stereoselective or chirally controlled preparation of oligonucleotides, each chiral internucleotidic linkage is formed with greater than 90:10, 95:5, 96:4, 97:3, or 98:2 diastereoselectivity. In some embodiments, for a stereoselective or chirally controlled preparation of oligonucleotides, each chiral internucleotidic linkage is formed with greater than 95:5 diastereoselectivity. In some embodiments, for a stereoselective or chirally controlled preparation of oligonucleotides, each chiral internucleotidic linkage is formed with greater than 96:4 diastereoselectivity. In some embodiments, for a stereoselective or chirally controlled preparation of oligonucleotides, each chiral internucleotidic linkage is formed with greater than 97:3 diastereoselectivity. In some embodiments, for a stereoselective or chirally controlled preparation of oligonucleotides, each chiral internucleotidic linkage is formed with greater than 98:2 diastereoselectivity. In some embodiments, for a stereoselective or chirally controlled preparation of oligonucleotides, each chiral internucleotidic linkage is formed with greater than 99:1 diastereoselectivity. In some embodiments, diastereoselectivity of a chiral internucleotidic linkage in an oligonucleotide may be measured through a model reaction, e.g. formation of a dimer under essentially the same or comparable conditions wherein the dimer has the same internucleotidic linkage as the chiral internucleotidic linkage, the 5'-nucleoside of the dimer is the same as the nucleoside to the 5'-end of the chiral internucleotidic linkage, and the 3'-nucleoside of the dimer is the same as the nucleoside to the 3'-end of the chiral internucleotidic linkage.

In some embodiments, a chirally controlled oligonucleotide composition is a composition designed to comprise multiple oligonucleotide types. In some embodiments, methods of the present disclosure allow for the generation of a library of chirally controlled oligonucleotides such that a pre-selected amount of any one or more chirally controlled oligonucleotide types can be mixed with any one or more other chirally controlled oligonucleotide types to create a chirally controlled oligonucleotide composition. In some embodiments, the pre-selected amount of an oligonucleotide type is a composition having any one of the above-described diastereomeric purities.

In some embodiments, the present disclosure provides methods for making a chirally controlled oligonucleotide comprising steps of:

(1) coupling;
(2) capping;
(3) modifying;
(4) deblocking; and
(5) repeating steps (1)-(4) until a desired length is achieved.

When describing the provided methods, the word "cycle" has its ordinary meaning as understood by a person of ordinary skill in the art. In some embodiments, one round of steps (1)-(4) is referred to as a cycle.

In some embodiments, the present disclosure provides methods for making chirally controlled oligonucleotide compositions, comprising steps of:

(a) providing an amount of a first chirally controlled oligonucleotide; and
(b) optionally providing an amount of one or more additional chirally controlled oligonucleotides.

In some embodiments, a first chirally controlled oligonucleotide is an oligonucleotide type, as described herein. In some embodiments, a one or more additional chirally controlled oligonucleotide is a one or more oligonucleotide type, as described herein.

One of skill in the relevant chemical and synthetic arts will recognize the degree of versatility and control over structural variation and stereochemical configuration of a provided oligonucleotide when synthesized using methods of the present disclosure. For instance, after a first cycle is complete, a subsequent cycle can be performed using a nucleotide unit individually selected for that subsequent cycle which, in some embodiments, comprises a nucleobase and/or a sugar that is different from the first cycle nucleobase and/or sugar. Likewise, the chiral auxiliary used in the coupling step of the subsequent cycle can be different from the chiral auxiliary used in the first cycle, such that the second cycle generates a phosphorus linkage of a different stereochemical configuration. In some embodiments, the stereochemistry of the linkage phosphorus in the newly formed internucleotidic linkage is controlled by using stereochemically pure phosphoramidites. Additionally, the modification reagent used in the modifying step of a subsequent cycle can be different from the modification reagent used in the first or former cycle. The cumulative effect of this iterative assembly approach is such that each component of a provided oligonucleotide can be structurally and configurationally tailored to a high degree. An additional advantage to this approach is that the step of capping minimizes the formation of "n−1" impurities that would otherwise make isolation of a provided oligonucleotide extremely challenging, and especially oligonucleotides of longer lengths.

In some embodiments, an example cycle of the method for making chirally controlled oligonucleotides is illustrated in example schemes described in the present disclosure. In some embodiments, an example cycle of the method for making chirally controlled oligonucleotides is illustrated in Scheme I. In some embodiments,

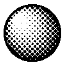

represents the solid support, and optionally a portion of the growing chirally controlled oligonucleotide attached to the solid support. The chiral auxiliary exemplified has the structure of formula 3-I:

Formula 3-I

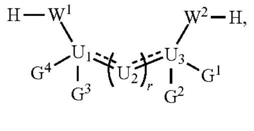

which is further described below. "Cap" is any chemical moiety introduced to the nitrogen atom by the capping step, and in some embodiments, is an amino protecting group. One of ordinary skill in the art understands that in the first cycle, there may be only one nucleoside attached to the solid support when started, and cycle exit can be performed optionally before deblocking. As understood by a person of skill in the art, $B^{PRO}$ is a protected base used in oligonucleotide synthesis. Each step of the above-depicted cycle of Scheme I is described further below.

Scheme I. Synthesis of chirally controlled oligonucleotide.

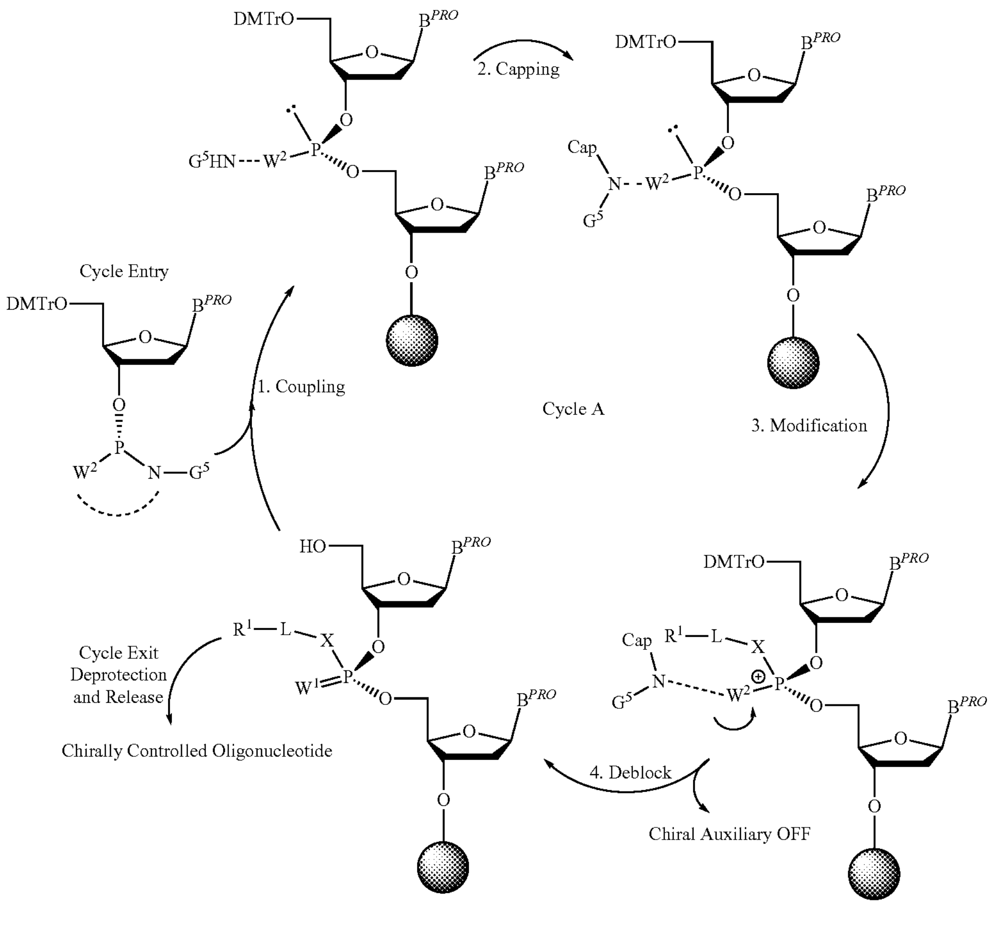

Synthesis on Solid Support

In some embodiments, the synthesis of a provided oligonucleotide is performed on solid phase. In some embodiments, reactive groups present on a solid support are protected. In some embodiments, reactive groups present on a solid support are unprotected. During oligonucleotide synthesis a solid support is treated with various reagents in several synthesis cycles to achieve the stepwise elongation of a growing oligonucleotide chain with individual nucleotide units. The nucleoside unit at the end of the chain which is directly linked to the solid support is termed "the first nucleoside" as used herein. A first nucleoside is bound to a solid support via a linker moiety, i.e. a diradical with covalent bonds between either of a CPG, a polymer or other solid support and a nucleoside. The linker stays intact during the synthesis cycles performed to assemble the oligonucleotide chain and is cleaved after the chain assembly to liberate the oligonucleotide from the support.

Solid supports for solid-phase nucleic acid synthesis include the supports described in, e.g., U.S. Pat. Nos. 4,659,774, 5,141,813, 4,458,066; Caruthers U.S. Pat. Nos. 4,415,732, 4,458,066, 4,500,707, 4,668,777, 4,973,679, and 5,132,418; Andrus et al. U.S. Pat. Nos. 5,047,524, 5,262,530; and Koster U.S. Pat. No. 4,725,677 (reissued as RE34,069). In some embodiments, a solid phase is an organic polymer support. In some embodiments, a solid phase is an inorganic polymer support. In some embodiments, an organic polymer support is polystyrene, aminomethyl polystyrene, a polyethylene glycol-polystyrene graft copolymer, polyacrylamide, polymethacrylate, polyvinylalcohol, highly cross-linked polymer (HCP), or other synthetic polymers, carbohydrates such as cellulose and starch or other polymeric carbohydrates, or other organic polymers and any copolymers, composite materials or combination of the above inorganic or organic materials. In some embodiments, an inorganic polymer support is silica, alumina, controlled polyglass (CPG), which is a silica-gel support, or aminopropyl CPG. Other useful solid supports include fluorous solid supports (see e.g., WO/2005/070859), long chain alkylamine (LCAA) controlled pore glass (CPG) solid supports (see e.g., S. P. Adams, K. S. Kavka, E. J. Wykes, S. B. Holder and G. R. Galluppi, *J. Am. Chem. Soc.,* 1983, 105, 661-663; G. R. Gough, M. J. Bruden and P. T. Gilham, *Tetrahedron Lett.,* 1981, 22, 4177-4180). Membrane supports and polymeric membranes (see e.g. Innovation and Perspectives in Solid Phase Synthesis, Peptides, Proteins and Nucleic Acids, ch 21 pp 157-162, 1994, Ed. Roger Epton and U.S. Pat. No. 4,923,901) are also useful for the synthesis of nucleic acids. Once formed, a membrane can be chemically functionalized for use in nucleic acid synthesis. In addition to the attachment of a functional group to the membrane, the use of a linker or spacer group attached to the membrane is also used in some embodiments to minimize steric hindrance between the membrane and the synthesized chain.

Other suitable solid supports include those generally known in the art to be suitable for use in solid phase methodologies, including, for example, glass sold as Primer™ 200 support, controlled pore glass (CPG), oxalyl-controlled pore glass (see, e.g., Alul, et al., *Nucleic Acids Research,* 1991, 19, 1527), TentaGel Support—an aminopolyethyleneglycol derivatized support (see, e.g., Wright, et al., *Tetrahedron Lett.,* 1993, 34, 3373), and Poros—a copolymer of polystyrene/divinylbenzene.

Surface activated polymers have been demonstrated for use in synthesis of natural and modified nucleic acids and proteins on several solid supports mediums. A solid support material can be any polymer suitably uniform in porosity, having sufficient amine content, and sufficient flexibility to undergo any attendant manipulations without losing integrity. Examples of suitable selected materials include nylon, polypropylene, polyester, polytetrafluoroethylene, polystyrene, polycarbonate, and nitrocellulose. Other materials can serve as a solid support, depending on the design of the investigator. In consideration of some designs, for example, a coated metal, in particular gold or platinum can be selected (see e.g., US publication No. 20010055761). In one embodiment of oligonucleotide synthesis, for example, a nucleoside is anchored to a solid support which is functionalized with hydroxyl or amino residues. Alternatively, a solid support is derivatized to provide an acid labile trialkoxytrityl group, such as a trimethoxytrityl group (TMT). Without being bound by theory, it is expected that the presence of a trialkoxytrityl protecting group will permit initial detritylation under conditions commonly used on DNA synthesizers. For a faster release of oligonucleotide material in solution with aqueous ammonia, a diglycoate linker is optionally introduced onto the support.

In some embodiments, a provided oligonucleotide alternatively is synthesized from the 5' to 3' direction. In some embodiments, a nucleic acid is attached to a solid support through its 5' end of the growing nucleic acid, thereby presenting its 3' group for reaction, i.e. using 5'-nucleoside phosphoramidites or in enzymatic reaction (e.g. ligation and polymerization using nucleoside 5'-triphosphates). When considering the 5' to 3' synthesis the iterative steps of the present disclosure remain unchanged (i.e. capping and modification on the chiral phosphorus).

Linking Moiety

A linking moiety or linker is optionally used to connect a solid support to a compound comprising a free nucleophilic moiety. Suitable linkers are known such as short molecules which serve to connect a solid support to functional groups (e.g., hydroxyl groups) of initial nucleosides molecules in solid phase synthetic techniques. In some embodiments, the linking moiety is a succinamic acid linker, or a succinate linker ($—CO—CH_2—CH_2—CO—$), or an oxalyl linker ($—CO—CO—$). In some embodiments, the linking moiety and the nucleoside are bonded together through an ester bond. In some embodiments, a linking moiety and a nucleoside are bonded together through an amide bond. In some embodiments, a linking moiety connects a nucleoside to another nucleotide or nucleic acid. Suitable linkers are disclosed in, for example, *Oligonucleotides And Analogues A Practical Approach*, Ekstein, F. Ed., IRL Press, N.Y., 1991, Chapter 1 and Solid-Phase Supports for Oligonucleotide Synthesis, Pon, R. T., *Curr. Prot. Nucleic Acid Chem.,* 2000, 3.1.1-3.1.28.

A linker moiety is used to connect a compound comprising a free nucleophilic moiety to another nucleoside, nucleotide, or nucleic acid. In some embodiments, a linking moiety is a phosphodiester linkage. In some embodiments, a linking moiety is an H-phosphonate moiety. In some embodiments, a linking moiety is a modified phosphorus linkage as described herein. In some embodiments, a universal linker (UnyLinker) is used to attached the oligonucleotide to the solid support (Ravikumar et al., *Org. Process Res. Dev.,* 2008, 12 (3), 399-410). In some embodiments, other universal linkers are used (Pon, R. T., *Curr. Prot. Nucleic Acid Chem.,* 2000, 3.1.1-3.1.28). In some embodiments, various orthogonal linkers (such as disulfide linkers) are used (Pon, R. T., *Curr. Prot. Nucleic Acid Chem.,* 2000, 3.1.1-3.1.28).

Among other things, the present disclosure recognizes that a linker can be chosen or designed to be compatible with a set of reaction conditions employed in oligonucleotide synthesis. In some embodiments, to avoid degradation of oligonucleotides and to avoid desulfurization, auxiliary groups are selectively removed before de-protection. In some embodiments, DPSE group can selectively be removed by $F^-$ ions. In some embodiments, the present disclosure provides linkers that are stable under a DPSE de-protection condition, e.g., 0.1M TBAF in MeCN, 0.5M $HIF-Et_3N$ in THF or MeCN, etc. In some embodiments, a provided linker is the SP linker. In some embodiments, the present disclosure demonstrates that the SP linker is stable under a DPSE de-protection condition, e.g., 0.1M TBAF in MeCN, 0.5M $HF-Et_3N$ in THE or MeCN, etc.; they are also stable, e.g., under anhydrous basic conditions, such as om1M DBU in MeCN.

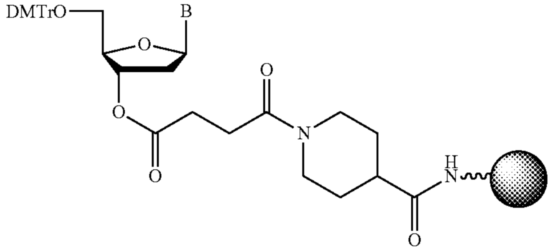

succinyl-piperidine (SP) linker

In some embodiments, an example linker is:

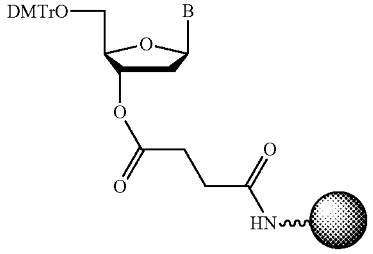

succinyl linker

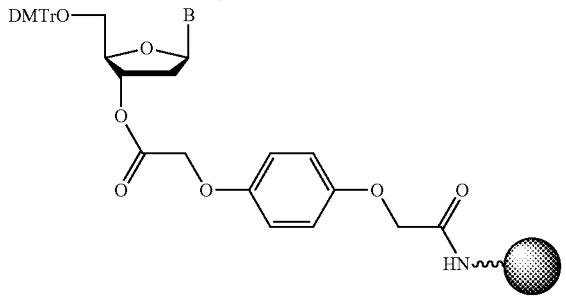

Q-linker

-continued

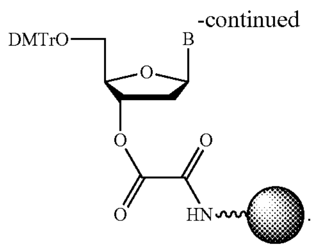

oxalyl linker

In some embodiments, the succinyl linker, Q-linker or oxalyl linker is not stable to one or more DPSE-deprotection conditions using $F^-$.

General Conditions—Solvents for Synthesis

Syntheses of provided oligonucleotides are generally performed in aprotic organic solvents. In some embodiments, a solvent is a nitrile solvent such as, e.g., acetonitrile. In some embodiments, a solvent is a basic amine solvent such as, e.g., pyridine. In some embodiments, a solvent is an ethereal solvent such as, e.g., tetrahydrofuran. In some embodiments, a solvent is a halogenated hydrocarbon such as, e.g., dichloromethane. In some embodiments, a mixture of solvents is used. In certain embodiments a solvent is a mixture of any one or more of the above-described classes of solvents.

In some embodiments, when an aprotic organic solvent is not basic, a base is present in the reacting step. In some embodiments where a base is present, the base is an amine base such as, e.g., pyridine, quinoline, or N,N-dimethylaniline. Example other amine bases include pyrrolidine, piperidine, N-methyl pyrrolidine, pyridine, quinoline, N,N-dimethylaminopyridine (DMAP), or N,N-dimethylaniline.

In some embodiments, a base is other than an amine base.

In some embodiments, an aprotic organic solvent is anhydrous. In some embodiments, an anhydrous aprotic organic solvent is freshly distilled. In some embodiments, a freshly distilled anhydrous aprotic organic solvent is a basic amine solvent such as, e.g., pyridine. In some embodiments, a freshly distilled anhydrous aprotic organic solvent is an ethereal solvent such as, e.g., tetrahydrofuran. In some embodiments, a freshly distilled anhydrous aprotic organic solvent is a nitrile solvent such as, e.g., acetonitrile.

Chiral Reagent/Chiral Auxiliary

In some embodiments, chiral reagents are used to confer stereoselectivity in the production of chirally controlled oligonucleotides. Many different chiral reagents, also referred to by those of skill in the art and herein as chiral auxiliaries, may be used in accordance with methods of the present disclosure. Examples of such chiral reagents are described herein and in Wada I, II and III, referenced above. In certain embodiments, a chiral reagent is as described by Wada I. In some embodiments, a chiral reagent for use in accordance with the methods of the present disclosure are of Formula 3-I, below:

Formula 3-I

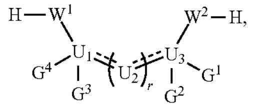

wherein $W^1$ and $W^2$ are any of —O—, —S—, or $-NG^5-$, $U_1$ and $U_3$ are carbon atoms which are bonded to $U_2$ if present, or to each other if r is 0, via a single, double or triple bond. $U_2$ is —C—, $-CG^8-$, $—CG^8G^8-$, $—NG^8-$, —N—, —O—, or —S— where r is an integer of 0 to 5 and no more than two heteroatoms are adjacent. When any one of $U_2$ is C, a triple bond must be formed between a second instance of $U_2$, which is C, or to one of $U_1$ or $U_3$. Similarly, when any one of $U_2$ is $CG^8$, a double bond is formed between a second instance of $U_2$ which is $—CG^8$-or —N—, or to one of $U_1$ or $U_3$.

In some embodiments, $-U_1G^3G^4-(U_2)_r—U_3G^1G^2$-is $—CG^3G^4-CG^1G^2-$. In some embodiments, $—U_1—(U_2)_r—U_3—$ is $—CG^3{=}CG^8-$. In some embodiments, $—U_1—(U_2)_r—U_3—$ is —C≡C—. In some embodiments, $—U_1—(U_2)_r—U_3—$ is $—CG^3{=}CG^8-CG^1G^2-$. In some embodiments, $—U_1—(U_2)_r—U_3—$ is $—CG^3G^4-O-CG^1G^2-$. In some embodiments, $—U_1—(U_2)_r—U_3—$ is $—CG^3G^4-NG^8-CG^1G^2-$. In some embodiments, $—U_1—(U_2)_r—U_3—$ is $—CG^3G^4-N-CG^2-$. In some embodiments, $—U_1—(U_2)_r—U_3—$ is $—CG^3G^4-N{=}C\ G^8-CG^1G^2-$.

As defined herein, $G^1$, $G^2$, $G^3$, $G^4$, $G^5$, and $G^8$ are independently hydrogen, or an optionally substituted group selected from alkyl, aralkyl, cycloalkyl, cycloalkylalkyl, heterocyclyl, heteroaryl, and aryl; or two of $G^1$, $G^2$, $G^3$, $G^4$, and $G^5$ are $G^6$ (taken together to form an optionally substituted, saturated, partially unsaturated or unsaturated carbocyclic or heteroatom-containing ring of up to about 20 ring atoms which is monocyclic or polycyclic, and is fused or unfused). In some embodiments, a ring so formed is substituted by oxo, thioxo, alkyl, alkenyl, alkynyl, heteroaryl, or aryl moieties. In some embodiments, when a ring formed by taking two $G^6$ together is substituted, it is substituted by a moiety which is bulky enough to confer stereoselectivity during the reaction.

In some embodiments, a ring formed by taking two of $G^6$ together is optionally substituted cyclopentyl, pyrrolyl, cyclopropyl, cyclohexenyl, cyclopentenyl, tetrahydropyranyl, or piperazinyl. In some embodiments, a ring formed by taking two of $G^6$ together is optionally substituted cyclopentyl, pyrrolyl, cyclopropyl, cyclohexenyl, cyclopentenyl, tetrahydropyranyl, pyrrolidinyl, or piperazinyl.

In some embodiments, $G^1$ is optionally substituted phenyl. In some embodiments, $G^1$ is phenyl. In some embodiments, $G^2$ is methyl or hydrogen. In some embodiments, $G^1$ is optionally substituted phenyl and $G^2$ is methyl. In some embodiments, $G^1$ is phenyl and $G^2$ is methyl.

In some embodiments, r is 0.

In some embodiments, $W^1$ is $—NG^5-$. In some embodiments, one of $G^3$ and $G^4$ is taken together with $G^5$ to form an optionally substituted pyrrolidinyl ring. In some embodiments, one of $G^3$ and $G^4$ is taken together with $G^5$ to form a pyrrolidinyl ring.

In some embodiments, $W^2$ is —O—.

In some embodiments, a chiral reagent is a compound of Formula 3-AA:

Formula 3-AA

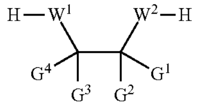

wherein each variable is independently as defined above and described herein.

In some embodiments of Formula 3AA, $W^1$ and $W^2$ are independently $—NG^5-$, —O—, or —S—; $G^1$, $G^2$, $G^3$, $G^4$, and $G^5$ are independently hydrogen, or an optionally substituted group selected from alkyl, aralkyl, cycloalkyl, cycloalkylalkyl, heterocyclyl, heteroaryl, or aryl; or two of $G^1$, $G^2$, $G^3$, $G^4$, and $G^5$ are $G^6$ (taken together to form an optionally substituted saturated, partially unsaturated or unsaturated carbocyclic or heteroatom-containing ring of up to about 20 ring atoms which is monocyclic or polycyclic, fused or unfused), and no more than four of $G^1$, $G^2$, $G^3$, $G^4$, and $G^5$ are $G^6$. Similarly to the compounds of Formula 3-I, any of $G^1$, $G^2$, $G^3$, $G^4$, or $G^5$ are optionally substituted by oxo, thioxo, alkyl, alkenyl, alkynyl, heteroaryl, or aryl moieties. In some embodiments, such substitution induces stereoselectivity in chirally controlled oligonucleotide production.

In some embodiments, a provided chiral reagent has the structure of

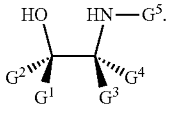

In some embodiments, a provided chiral reagent has the structure of

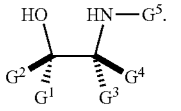

In some embodiments, a provided chiral reagent has the structure of

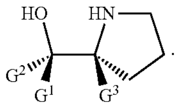

In some embodiments, a provided chiral reagent has the structure of

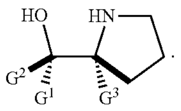

In some embodiments, a provided chiral reagent has the structure of

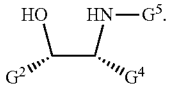

In some embodiments, a provided chiral reagent has the structure of

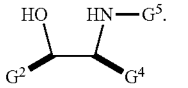

In some embodiments, a provided chiral reagent has the structure of

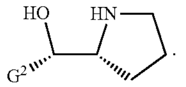

In some embodiments, a provided chiral reagent has the structure of

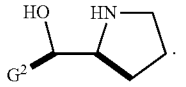

In some embodiments, $W^1$ is $-NG^5$, $W^2$ is O, each of $G^1$ and $G^3$ is independently hydrogen or an optionally substituted group selected from $C_{1-10}$ aliphatic, heterocyclyl, heteroaryl and aryl, $G^2$ is $-C(R)_2Si(R)_3$, and $G^4$ and $G^5$ are taken together to form an optionally substituted saturated, partially unsaturated or unsaturated heteroatom-containing ring of up to about 20 ring atoms which is monocyclic or polycyclic, fused or unfused. In some embodiments, each R is independently hydrogen, or an optionally substituted group selected from $C_1$-$C_6$ aliphatic, carbocyclyl, aryl, heteroaryl, and heterocyclyl. In some embodiments, $G^2$ is $-C(R)_2Si(R)_3$, wherein $-C(R)_2-$ is optionally substituted $-CH_2-$, and each R of $-Si(R)_3$ is independently an optionally substituted group selected from $C_{1-10}$ aliphatic, heterocyclyl, heteroaryl and aryl. In some embodiments, at least one R of $-Si(R)_3$ is independently optionally substituted $C_{1-10}$ alkyl. In some embodiments, at least one R of $-Si(R)_3$ is independently optionally substituted phenyl. In some embodiments, one R of $-Si(R)_3$ is independently optionally substituted phenyl, and each of the other two R is independently optionally substituted $C_{1-10}$ alkyl. In some embodiments, one R of $-Si(R)_3$ is independently optionally substituted $C_{1-10}$ alkyl, and each of the other two R is independently optionally substituted phenyl. In some embodiments, $G^2$ is optionally substituted $-CH_2Si(Ph)(Me)_2$. In some embodiments, $G^2$ is optionally substituted $-CH_2Si(Me)(Ph)_2$. In some embodiments, $G^2$ is $-CH_2Si(Me)(Ph)_2$. In some embodiments, $G^4$ and $G^5$ are taken together to form an optionally substituted saturated 5-6 membered ring containing one nitrogen atom (to which $G^5$ is attached). In some embodiments, $G^4$ and $G^5$ are taken together to form an optionally substituted saturated 5-membered ring containing one nitrogen atom. In some embodiments, $G^1$ is hydrogen. In some embodiments, $G^3$ is hydrogen. In some embodiments, both $G^1$ and $G^3$ are hydrogen.

In some embodiments, a chiral reagent has one of the following formulae:

Formulae 3-AB

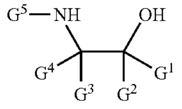

3-BB

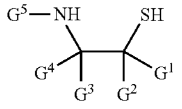

-continued

3-CC

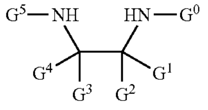

3-DD

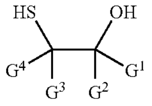

3-EE

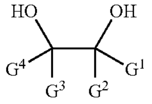

3-FF

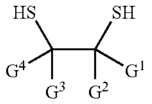

In some embodiments, a chiral reagent is an aminoalcohol. In some embodiments, a chiral reagent is an aminothiol. In some embodiments, a chiral reagent is an aminophenol. In some embodiments, a chiral reagent is (S)-and (R)-2-methylamino-1-phenylethanol, (1R, 2S)-ephedrine, or (1R, 2S)-2-methylamino-1,2-diphenylethanol.

In some embodiments of the disclosure, a chiral reagent is a compound of one of the following formulae:

Formula O

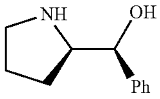

Formula P

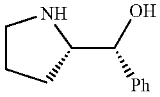

Formula Q

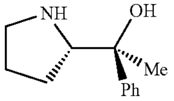

Formula R

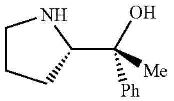

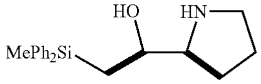

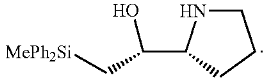

DPSE

As demonstrated herein, when used for preparing a chiral internucleotidic linkage, to obtain stereoselectivity generally stereochemically pure chiral reagents are utilized. Among other things, the present disclosure provides stereochemically pure chiral reagents, including those having structures described.

The choice of chiral reagent, for example, the isomer represented by Formula Q or its stereoisomer, Formula R, permits specific control of chirality at a linkage phosphorus.

Thus, either an Rp or Sp configuration can be selected in each synthetic cycle, permitting control of the overall three dimensional structure of a chirally controlled oligonucleotide. In some embodiments, a chirally controlled oligonucleotide has all Rp stereocenters. In some embodiments of the disclosure, a chirally controlled oligonucleotide has all Sp stereocenters. In some embodiments of the disclosure, each linkage phosphorus in the chirally controlled oligonucleotide is independently Rp or Sp. In some embodiments of the disclosure, each linkage phosphorus in the chirally controlled oligonucleotide is independently Rp or Sp, and at least one is Rp and at least one is Sp. In some embodiments, the selection of Rp and Sp centers is made to confer a specific three dimensional superstructure to a chirally controlled oligonucleotide. Examples of such selections are described in further detail herein.

In some embodiments, a chiral reagent for use in accordance with the present disclosure is selected for its ability to be removed at a particular step in the above-depicted cycle. For example, in some embodiments it is desirable to remove a chiral reagent during the step of modifying the linkage phosphorus. In some embodiments, it is desirable to remove a chiral reagent before the step of modifying the linkage phosphorus. In some embodiments, it is desirable to remove a chiral reagent after the step of modifying the linkage phosphorus. In some embodiments, it is desirable to remove a chiral reagent after a first coupling step has occurred but before a second coupling step has occurred, such that a chiral reagent is not present on the growing oligonucleotide during the second coupling (and likewise for additional subsequent coupling steps). In some embodiments, a chiral reagent is removed during the "deblock" reaction that occurs after modification of the linkage phosphorus but before a subsequent cycle begins. Example methods and reagents for removal are described herein.

In some embodiments, removal of chiral auxiliary is achieved when performing the modification and/or deblocking step, as illustrated in Scheme I. It can be beneficial to combine chiral auxiliary removal together with other transformations, such as modification and deblocking. A person of ordinary skill in the art would appreciate that the saved steps/transformation could improve the overall efficiency of synthesis, for instance, with respect to yield and product purity, especially for longer oligonucleotides. One example wherein the chiral auxiliary is removed during modification and/or deblocking is illustrated in Scheme I.

In some embodiments, a chiral reagent for use in accordance with methods of the present disclosure is characterized in that it is removable under certain conditions. For instance, in some embodiments, a chiral reagent is selected for its ability to be removed under acidic conditions. In certain embodiments, a chiral reagent is selected for its ability to be removed under mildly acidic conditions. In certain embodiments, a chiral reagent is selected for its ability to be removed by way of an E1 elimination reaction (e.g., removal occurs due to the formation of a cation intermediate on the chiral reagent under acidic conditions, causing the chiral reagent to cleave from the oligonucleotide). In some embodiments, a chiral reagent is characterized in that it has a structure recognized as being able to accommodate or facilitate an E1 elimination reaction. One of skill in the relevant arts will appreciate which structures would be envisaged as being prone toward undergoing such elimination reactions.

In some embodiments, a chiral reagent is selected for its ability to be removed with a nucleophile. In some embodiments, a chiral reagent is selected for its ability to be removed with an amine nucleophile. In some embodiments, a chiral reagent is selected for its ability to be removed with a nucleophile other than an amine.

In some embodiments, a chiral reagent is selected for its ability to be removed with a base. In some embodiments, a chiral reagent is selected for its ability to be removed with an amine. In some embodiments, a chiral reagent is selected for its ability to be removed with a base other than an amine.

Additional chiral auxiliaries and their use can be found in e.g., Wada I (JP4348077; WO2005/014609; WO2005/092909), Wada II (WO2010/064146), Wada III (WO2012/039448), Chiral Control (WO2010/064146), etc.

Activation

An achiral H-phosphonate moiety is treated with the first activating reagent to form the first intermediate. In one embodiment, the first activating reagent is added to the reaction mixture during the condensation step. Use of the first activating reagent is dependent on reaction conditions such as solvents that are used for the reaction. Examples of the first activating reagent are phosgene, trichloromethyl chloroformate, bis(trichloromethyl)carbonate (BTC), oxalyl chloride, $Ph_3PCl_2$, $(PhO)_3PCl_2$, N,N'-bis(2-oxo-3-oxazolidinyl)phosphinic chloride (BopCl), 1,3-dimethyl-2-(3-nitro-1,2,4-triazol-1-yl)-2-pyrrolidin-1-yl-1,3,2-diazaphospholidinium hexafluorophosphate (MNTP), or 3-nitro-1,2,4-triazol-1-yl-tris(pyrrolidin-1-yl)phosphonium hexafluorophosphate (PyNTP).

The example of achiral H-phosphonate moiety is a compound shown in the above Scheme. DBU represents 1,8-diazabicyclo[5.4.0]undec-7-ene. $H^+DBU$ may be, for example, ammonium ion, alkylammonium ion, heteroaromatic iminium ion, or heterocyclic iminium ion, any of which is primary, secondary, tertiary or quaternary, or a monovalent metal ion.

Reacting with Chiral Reagent

After the first activation step, the activated achiral H-phosphonate moiety reacts with a chiral reagent, which is represented by formula (Z-I) or (Z-I'), to form a chiral intermediate of formula (Z-Va), (Z-Vb), (Z-Va'), or (Z-Vb').

Stereospecific Condensation Step

A chiral intermediate of Formula Z-Va ((Z-Vb), (Z-Va'), or (Z-Vb')) is treated with the second activating reagent and a nucleoside to form a condensed intermediate. The nucleoside may be on solid support. Examples of the second activating reagent are 4,5-dicyanoimidazole (DCI), 4,5-dichloroimidazole, 1-phenylimidazolium triflate (PhIMT), benzimidazolium triflate (BIT), benztriazole, 3-nitro-1,2,4-triazole (NT), tetrazole, 5-ethylthiotetrazole (ETT), 5-benzylthiotetrazole (BTT), 5-(4-nitrophenyl)tetrazole, N-cyanomethylpyrrolidinium triflate (CMPT), N-cyanomethylpiperidinium triflate, N-cyanomethyldimethylammonium triflate. A chiral intermediate of Formula Z-Va ((Z-Vb), (Z-Va'), or (Z-Vb')) may be isolated as a monomer. Usually, the chiral intermediate of Z-Va ((Z-Vb), (Z-Va'), or (Z-Vb')) is not isolated and undergoes a reaction in the same pot with a nucleoside or modified nucleoside to provide a chiral phosphite compound, a condensed intermediate. In other embodiments, when the method is performed via solid phase synthesis, the solid support comprising the compound is filtered away from side products, impurities, and/or reagents.

Capping Step

If the final nucleic acid is larger than a dimer, the unreacted —OH moiety is capped with a blocking group and the chiral auxiliary in the compound may also be capped with a blocking group to form a capped condensed intermediate. If the final nucleic acid is a dimer, then the capping step is not necessary.

Modifying Step

The compound is modified by reaction with an electrophile. The capped condensed intermediate may be executed modifying step. In some embodiments, the modifying step is performed using a sulfur electrophile, a selenium electrophile or a boronating agent. Examples of modifying steps are step of oxidation and sulfurization.

In some embodiments of the method, the sulfur electrophile is a compound having one of the following formulas:

$S_8$(Formula Z-B), $Z^{z1}$—S—S—$Z^{z2}$, or $Z^{z1}$—S—$V^z$—$Z^{z2}$;

wherein $Z^{z1}$ and $Z^{z2}$ are independently alkyl, aminoalkyl, cycloalkyl, heterocyclic, cycloalkylalkyl, heterocycloalkyl, aryl, heteroaryl, alkyloxy, aryloxy, heteroaryloxy, acyl, amide, imide, or thiocarbonyl, or $Z^{z1}$ and $Z^{z2}$ are taken together to form a 3 to 8 membered alicyclic or heterocyclic ring, which may be substituted or unsubstituted; $V^z$ is $SO_2$, O, or $NR^f$; and $R^f$ is hydrogen, alkyl, alkenyl, alkynyl, or aryl.

In some embodiments of the method, the sulfur electrophile is a compound of following Formulae Z-A, Z-B, Z-C, Z-D, Z-E, or Z-F:

Formula Z-A

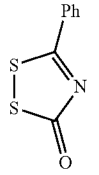

Formula Z-B $S_8$

Formula Z-C

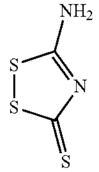

Formula Z-D

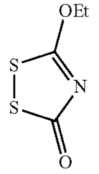

Formula Z-E

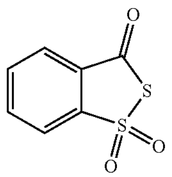

Formula Z-F

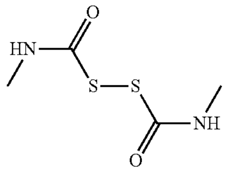

In some embodiments, a sulfurization reagent is 3-phenyl-1,2,4-dithiazolin-5-one.

In some embodiments, the selenium electrophile is a compound having one of the following formulae:

Se(Formula Z-G), $Z^{z3}$—Se—Se—$Z^{z4}$, or $Z^{z3}$—Se—$V^{z}$—$Z^{z4}$ wherein $Z^{z3}$ and $Z^{z4}$ are independently alkyl, aminoalkyl, cycloalkyl, heterocyclic, cycloalkylalkyl, heterocycloalkyl, aryl, heteroaryl, alkyloxy, aryloxy, heteroaryloxy, acyl, amide, imide, or thiocarbonyl, or $Z^{z3}$ and $Z^{z4}$ are taken together to form a 3 to 8 membered alicyclic or heterocyclic ring, which may be substituted or unsubstituted; $V^{z}$ is $SO_2$, S, O, or $NR^{f}$; and $R^{f}$ is hydrogen, alkyl, alkenyl, alkynyl, or aryl.

In some embodiments, the selenium electrophile is a compound of Formula Z-G, Z-H, Z-I, Z-J, Z-K, or Z-L.

Formula Z-G

Se

Formula Z-H

KSeCN

Formula Z-I

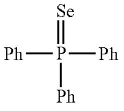

Formula Z-J

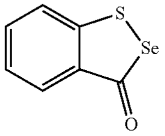

Formula Z-K

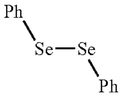

Formula Z-L

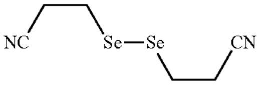

In some embodiments, the boronating agent is borane-N,N-diisopropylethylamine ($BH_3$ DIPEA), borane-pyridine ($BH_3$ Py), borane-2-chloropyridine ($BH_3$ CPy), borane-aniline ($BH_3$ An), borane-tetrahydrofiirane ($BH_3$ THF), or borane-dimethylsulfide ($BH_3$ $Me_2S$).

In some embodiments, after the modifying step, a chiral auxiliary group falls off from the growing oligonucleotide chain. In some embodiments, after the modifying step, a chiral auxiliary group remains connected to the internucleotidic phosphorus atom.

In some embodiments of the method, the modifying step is an oxidation step. In some embodiments of the method, the modifying step is an oxidation step using similar conditions as described above in this application. In some embodiments, an oxidation step is as disclosed in, e.g., JP 2010-265304 A and WO2010/064146.

Chain Elongation Cycle and De-Protection Step

The capped condensed intermediate is deblocked to remove the blocking group at the 5'-end of the growing nucleic acid chain to provide a compound. The compound is optionally allowed to re-enter the chain elongation cycle to form a condensed intermediate, a capped condensed intermediate, a modified capped condensed intermediate, and a 5'-deprotected modified capped intermediate. Following at least one round of chain elongation cycle, the 5'-deprotected modified capped intermediate is further deblocked by removal of the chiral auxiliary ligand and other protecting groups for, e.g., nucleobase, modified nucleobase, sugar and modified sugar protecting groups, to provide a nucleic acid. In other embodiments, the nucleoside comprising a 5'-OH moiety is an intermediate from a previous chain elongation cycle as described herein. In yet other embodiments, the nucleoside comprising a 5'-OH moiety is an intermediate obtained from another known nucleic acid synthetic method. In embodiments where a solid support is used, the phosphorus-atom modified nucleic acid is then cleaved from the solid support. In certain embodiments, the nucleic acids is left attached on the solid support for purification purposes and then cleaved from the solid support following purification.

In yet other embodiments, the nucleoside comprising a 5'-OH moiety is an intermediate obtained from another known nucleic acid synthetic method. In yet other embodiments, the nucleoside comprising a 5'-OH moiety is an intermediate obtained from another known nucleic acid synthetic method as described in this application. In yet other embodiments, the nucleoside comprising a 5'-OH moiety is an intermediate obtained from another known nucleic acid synthetic method comprising one or more cycles illustrated in Scheme I. In yet other embodiments, the nucleoside comprising a 5'-OH moiety is an intermediate obtained from another known nucleic acid synthetic method comprising one or more cycles illustrated in Scheme I-b, I-c or I-d.

In some embodiments, the present disclosure provides oligonucleotide synthesis methods that use stable and commercially available materials as starting materials. In some embodiments, the present disclosure provides oligonucleotide synthesis methods to produce stereocontrolled phosphorus atom-modified oligonucleotide derivatives using an achiral starting material.

In some embodiments, the method of the present disclosure does not cause degradations under the de-protection steps. Further the method does not require special capping agents to produce phosphorus atom-modified oligonucleotide derivatives.

Condensing Reagent

Condensing reagents ($C_R$) useful in accordance with methods of the present disclosure are of any one of the following general formulae:

$C_R1$

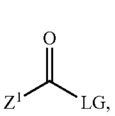

$C_R2$

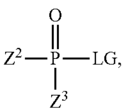

$C_R3$

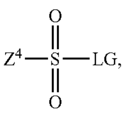

$C_R4$

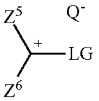

or

-continued $C_R5$

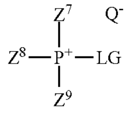

wherein $Z^1$, $Z^2$, $Z^3$, $Z^4$, $Z^5$, $Z^6$, $Z^7$, $Z^8$, and $Z^9$ are independently optionally substituted group selected from alkyl, aminoalkyl, cycloalkyl, heterocyclic, cycloalkylalkyl, heterocycloalkyl, aryl, heteroaryl, alkyloxy, aryloxy, or heteroaryloxy, or wherein any of $Z^2$ and $Z^3$, $Z^5$ and $Z^6$, $Z^7$ and $Z^8$, $Z^8$ and $Z^9$, $Z^9$ and $Z^7$, or $Z^7$ and $Z^8$ and $Z^9$ are taken together to form a 3 to 20 membered alicyclic or heterocyclic ring; $Q^-$ is a counter anion; and LG is a leaving group.

In some embodiments, a counter ion of a condensing reagent $C_R$ is $Cl^-$, $Br^-$, $BF_4^-$, $PF_6^-$, $TfO^-$, $Tf_2N^-$, $AsF_6^-$, $ClO_4^-$, or $SbF_6^-$, wherein Tf is $CF_3SO_2$. In some embodiments, a leaving group of a condensing reagent $C_R$ is F, Cl, Br, I, 3-nitro-1,2,4-triazole, imidazole, alkyltriazole, tetrazole, pentafluorobenzene, or 1-hydroxybenzotriazole.

Examples of condensing reagents used in accordance with methods of the present disclosure include, but are not limited to, pentafluorobenzoyl chloride, carbonyldiimidazole (CDI), 1-mesitylenesulfonyl-3-nitrotriazole (MSNT), 1-ethyl-3-(3'-dimethylaminopropyl)carbodiimide hydrochloride (EDCI—HCl), benzotriazole-1-yloxytris(dimethylamino)phosphonium hexafluorophosphate (PyBOP), N,N'-bis(2-oxo-3-oxazolidinyl)phosphinic chloride (BopCl), 2-(1H-7-azabenzotriazol-1-yl)-1,1,3,3-tetramethyluronium hexafluorophosphate (HATU), and O-benzotriazole-N,N,N',N'-tetramethyluronium hexafluorophosphate (HBTU), DIPCDI; N,N'-bis(2-oxo-3-oxazolidinyl)phosphinic bromide (BopBr), 1,3-dimethyl-2-(3-nitro-1,2,4-triazol-1-yl)-2-pyrrolidin-1-yl-1,3,2-diazaphospholidinium hexafluorophosphate (MNTP), 3-nitro-1,2,4-triazol-1-yl-tris(pyrrolidin-1-yl)phosphonium hexafluorophosphate (PyNTP), bromotripyrrolidinophosphonium hexafluorophosphate (PyBrOP); O-(benzotriazol-1-yl)-N,N,N',N'-tetramethyluronium tetrafluoroborate (TBTU); and tetramethylfluoroformamidinium hexafluorophosphate (TFFH). In certain embodiments, a counter ion of the condensing reagent $C_R$ is $Cl^-$, $Br^-$, $BF_4^-$, $PF_6^-$, $TfO^-$, $Tf_2N^-$, $AsF_6^-$, $ClO_4^-$, or $SbF_6^-$, wherein Tf is $CF_3SO_2$.

In some embodiments, a condensing reagent is 1-(2,4,6-triisopropylbenzenesulfonyl)-5-(pyridin-2-yl) tetrazolide, pivaloyl chloride, bromotrispyrrolidinophosphonium hexafluorophosphate, N,N'-bis(2-oxo-3-oxazolidinyl) phosphinic chloride (BopCl), or 2-chloro-5,5-dimethyl-2-oxo-1,3,2-dioxaphosphinane. In some embodiment, a condensing reagent is N,N'-bis(2-oxo-3-oxazolidinyl)phosphinic chloride (BopCl). In some embodiments, a condensing reagent is selected from those described in WO/2006/066260).

In some embodiments, a condensing reagent is 1,3-dimethyl-2-(3-nitro-1,2,4-triazol-1-yl)-2-pyrrolidin-1-yl-1,3,2-diazaphospholidinium hexafluorophosphate (MNTP), or 3-nitro-1,2,4-triazol-1-yl-tris(pyrrolidin-1-yl)phosphonium hexafluorophosphate (PyNTP):

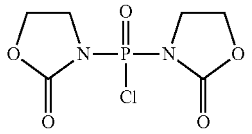

BopCl

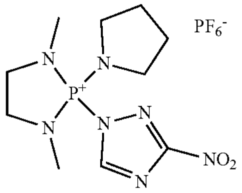

MNTP

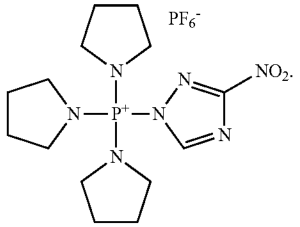

PyNTP

Selection of Base and Sugar of Nucleoside Coupling Partner

As described herein, nucleoside coupling partners for use in accordance with methods of the present disclosure can be the same as one another or can be different from one another. In some embodiments, nucleoside coupling partners for use in the synthesis of a provided oligonucleotide are of the same structure and/or stereochemical configuration as one another. In some embodiments, each nucleoside coupling partner for use in the synthesis of a provided oligonucleotide is not of the same structure and/or stereochemical configuration as certain other nucleoside coupling partners of the oligonucleotide. Example nucleobases and sugars for use in accordance with methods of the present disclosure are described herein. One of skill in the relevant chemical and synthetic arts will recognize that any combination of nucleobases and sugars described herein are contemplated for use in accordance with methods of the present disclosure.

Coupling Step

Example coupling procedures and chiral reagents and condensing reagents for use in accordance with the present disclosure are outlined in, inter alia, Wada I (JP4348077; WO2005/014609; WO2005/092909), Wada II (WO2010/064146), Wada III (WO2012/039448), and Chiral Control (WO2010/064146). Chiral nucleoside coupling partners for use in accordance with the present disclosure are also referred to herein as "Wada amidites." In some embodiments, a coupling partner has the structure of

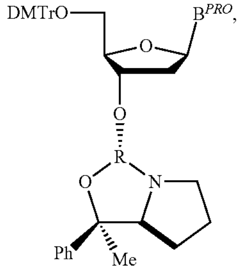

wherein $B^{PRO}$ is a protected nucleobase. In some embodiments, a coupling partner has the structure of

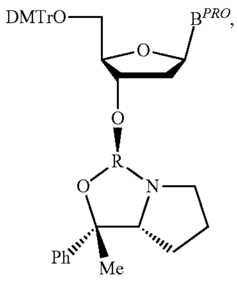

wherein $B^{PRO}$ is a protected nucleobase. In some embodiments, a coupling partner has the structure of

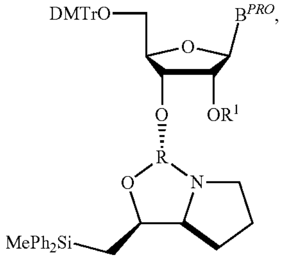

wherein $B^{PRO}$ is a protected nucleobase, and $R^1$ is as defined and described herein. In some embodiments, a coupling partner has the structure of

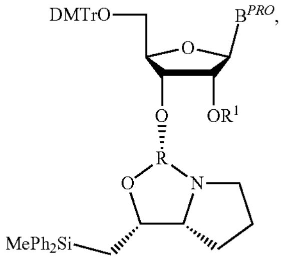

wherein $B^{PRO}$ is a protected nucleobase, and $R^1$ is as defined and described herein. In some embodiments, $R^1$ is optionally substituted $C_{1-6}$ alkyl. In some embodiments, $R^1$ is Me.

Example chiral phosphoramidites as coupling partner are depicted below:

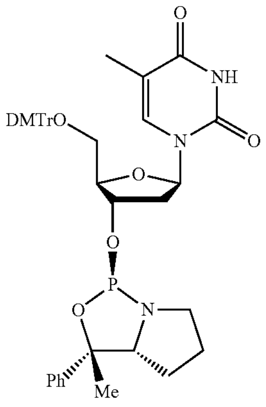

-continued

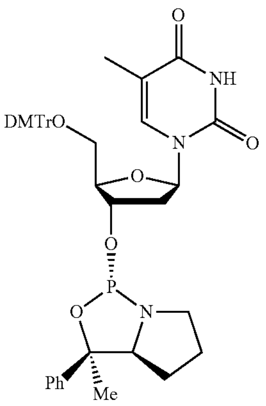

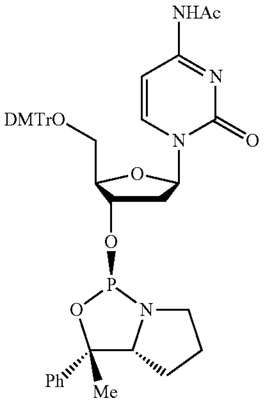

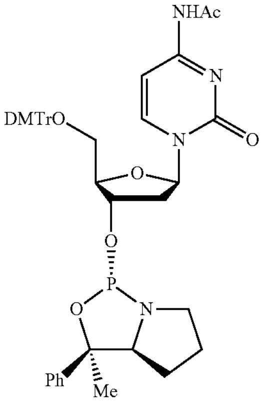

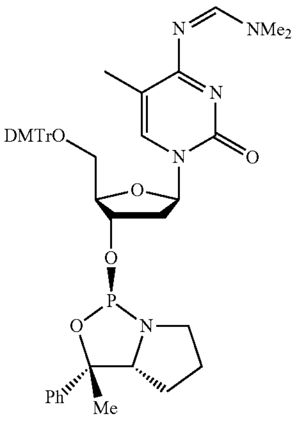

-continued
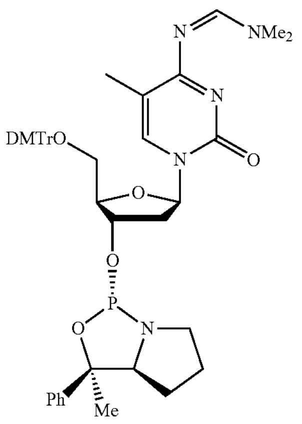
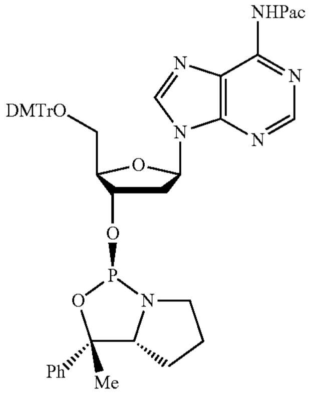
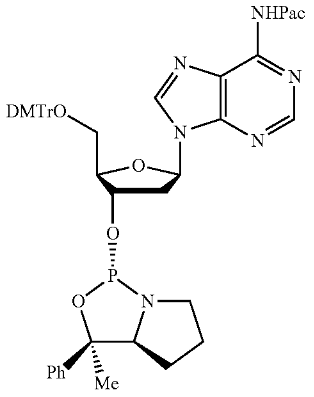
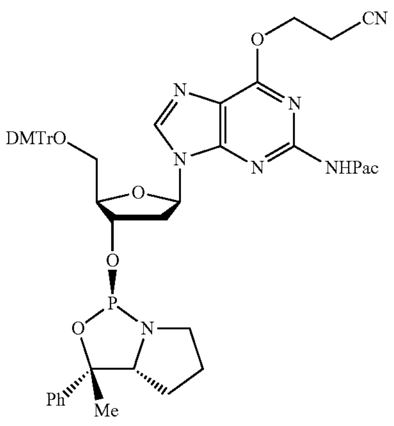
-continued
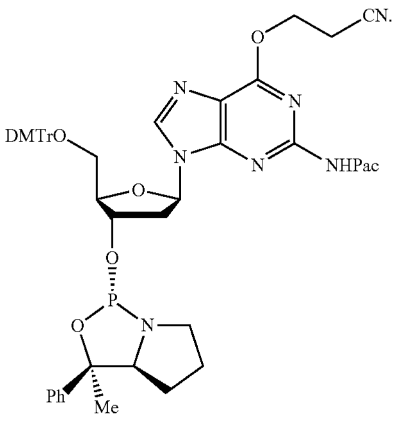
Additional examples are described in Chiral Control (WO2010/064146).
One of the methods used for synthesizing the coupling partner is depicted in Scheme II, below.
Scheme II. Example synthesis of coupling partner.
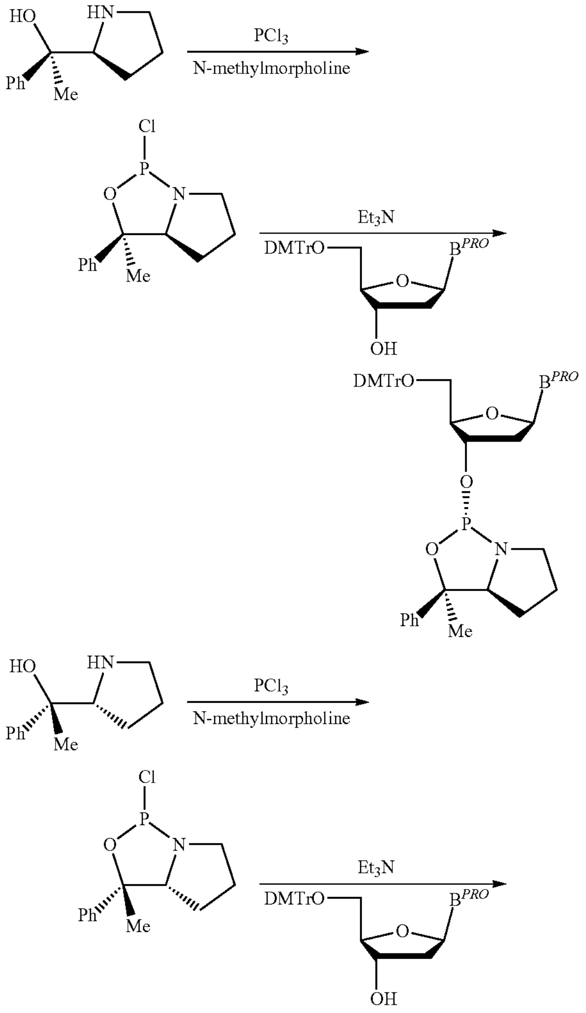

-continued

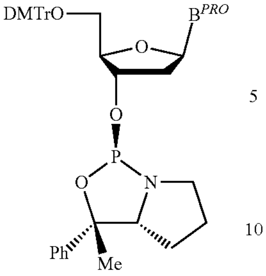

In some embodiments, the step of coupling comprises reacting a free hydroxyl group of a nucleotide unit of an oligonucleotide with a nucleoside coupling partner under suitable conditions to effect the coupling. In some embodiments, the step of coupling is preceded by a step of deblocking. For instance, in some embodiments, the 5' hydroxyl group of the growing oligonucleotide is blocked (i.e., protected) and must be deblocked in order to subsequently react with a nucleoside coupling partner.

Once the appropriate hydroxyl group of the growing oligonucleotide has been deblocked, the support is washed and dried in preparation for delivery of a solution comprising a chiral reagent and a solution comprising an activator. In some embodiments, a chiral reagent and an activator are delivered simultaneously. In some embodiments, co-delivery comprises delivering an amount of a chiral reagent in solution (e.g., a phosphoramidite solution) and an amount of activator in a solution (e.g., a CMPT solution) in a polar aprotic solvent such as a nitrile solvent (e.g., acetonitrile).

In some embodiments, the step of coupling provides a crude product composition in which the chiral phosphite product is present in a diastereomeric excess of >95%. In some embodiments, the chiral phosphite product is present in a diastereomeric excess of >96%. In some embodiments, the chiral phosphite product is present in a diastereomeric excess of >97%. In some embodiments, the chiral phosphite product is present in a diastereomeric excess of >98%. In some embodiments, the chiral phosphite product is present in a diastereomeric excess of >99%.

Capping Step:

Provided methods for making chirally controlled oligonucleotides comprise a step of capping. In some embodiments, a step of capping is a single step. In some embodiments, a step of capping is two steps. In some embodiments, a step of capping is more than two steps.

In some embodiments, a step of capping comprises steps of capping the free amine of the chiral auxiliary and capping any residual unreacted 5' hydroxyl groups. In some embodiments, the free amine of the chiral auxiliary and the unreacted 5' hydroxyl groups are capped with the same capping group. In some embodiments, the free amine of the chiral auxiliary and the unreacted 5' hydroxyl groups are capped with different capping groups. In certain embodiments, capping with different capping groups allows for selective removal of one capping group over the other during synthesis of the oligonucleotide. In some embodiments, the capping of both groups occurs simultaneously. In some embodiments, the capping of both groups occurs iteratively.

In certain embodiments, capping occurs iteratively and comprises a first step of capping the free amine followed by a second step of capping the free 5' hydroxyl group, wherein both the free amine and the 5' hydroxyl group are capped with the same capping group. For instance, in some embodiments, the free amine of the chiral auxiliary is capped using an anhydride (e.g., phenoxyacetic anhydride, i.e., $Pac_2O$) prior to capping of the 5' hydroxyl group with the same anhydride. In certain embodiments, the capping of the 5' hydroxyl group with the same anhydride occurs under different conditions (e.g., in the presence of one or more additional reagents). In some embodiments, capping of the 5' hydroxyl group occurs in the presence of an amine base in an etherial solvent (e.g., NMI (N-methylimidazole) in THF). The phrase "capping group" is used interchangeably herein with the phrases "protecting group" and "blocking group".

In some embodiments, an amine capping group is characterized in that it effectively caps the amine such that it prevents rearrangement and/or decomposition of the intermediate phosphite species. In some embodiments, a capping group is selected for its ability to protect the amine of the chiral auxiliary in order to prevent intramolecular cleavage of the internucleotide linkage phosphorus.

In some embodiments, a 5' hydroxyl group capping group is characterized in that it effectively caps the hydroxyl group such that it prevents the occurrence of "shortmers," e.g., "n−m" (m and n are integers and m<n; n is the number of bases in the targeted oligonucleotide) impurities that occur from the reaction of an oligonucleotide chain that fails to react in a first cycle but then reacts in one or more subsequent cycles. The presence of such shortmers, especially "n−1", has a deleterious effect upon the purity of the crude oligonucleotide and makes final purification of the oligonucleotide tedious and generally low-yielding.

In some embodiments, a particular cap is selected based on its tendency to facilitate a particular type of reaction under particular conditions. For instance, in some embodiments, a capping group is selected for its ability to facilitate an E1 elimination reaction, which reaction cleaves the cap and/or auxiliary from the growing oligonucleotide. In some embodiments, a capping group is selected for its ability to facilitate an E2 elimination reaction, which reaction cleaves the cap and/or auxiliary from the growing oligonucleotide. In some embodiments, a capping group is selected for its ability to facilitate a β-elimination reaction, which reaction cleaves the cap and/or auxiliary from the growing oligonucleotide.

Modifying Step:

As used herein, the phrase "modifying step", "modification step" and "P-modification step" are used interchangeably and refer generally to any one or more steps used to install a modified internucleotidic linkage. In some embodiments, the modified internucleotidic linkage having the structure of formula I. A P-modification step of the present disclosure occurs during assembly of a provided oligonucleotide rather than after assembly of a provided oligonucleotide is complete. Thus, each nucleotide unit of a provided oligonucleotide can be individually modified at the linkage phosphorus during the cycle within which the nucleotide unit is installed.

In some embodiments, a suitable P-modification reagent is a sulfur electrophile, selenium electrophile, oxygen electrophile, boronating reagent, or an azide reagent.

For instance, in some embodiments, a selemium reagent is elemental selenium, a selenium salt, or a substituted diselenide. In some embodiments, an oxygen electrophile is elemental oxygen, peroxide, or a substituted peroxide. In some embodiments, a boronating reagent is a borane-amine (e.g., N,N-diisopropylethylamine ($BH_3$DIPEA), borane-pyridine ($BH_3$ Py), borane-2-chloropyridine ($BH_3$ CPy), borane-aniline ($BH_3$ An)), a borane-ether reagent (e.g., borane-tetrahydrofuran ($BH_3$ THF)), a borane-dialkylsulfide reagent (e.g., $BH_3$ $Me_2S$), aniline-cyanoborane, or a triphenylphosphine-carboalkoxyborane. In some embodiments, an azide reagent is comprises an azide group capable of undergoing subsequent reduction to provide an amine group.

In some embodiments, a P-modification reagent is a sulfurization reagent as described herein. In some embodiments, a step of modifying comprises sulfurization of phosphorus to provide a phosphorothioate linkage or phosphorothioate triester linkage. In some embodiments, a step of modifying provides an oligonucleotide having an internucleotidic linkage of formula I.

In some embodiments, the present disclosure provides sulfurizing reagents, and methods of making, and use of the same.

In some embodiments, such sulfurizing reagents are thiosulfonate reagents. In some embodiments, a thiosulfonate reagent has a structure of formula S-I:

S-I

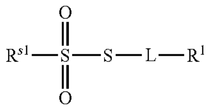

wherein:

$R^{s1}$ is R; and each of R, L and $R^1$ is independently as defined and described above and herein.

In some embodiments, the sulfurizing reagent is a bis(thiosulfonate) reagent. In some embodiments, the bis(thiosulfonate) reagent has the structure of formula S-II:

S-II

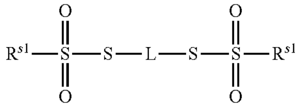

wherein each of $R^{s1}$ and L is independently as defined and described above and herein.

As defined generally above, $R^{s1}$ is R, wherein R is as defined and described above and herein. In some embodiments, $R^{s1}$ is optionally substituted aliphatic, aryl, heterocyclyl or heteroaryl. In some embodiments, $R^{s1}$ is optionally substituted alkyl. In some embodiments, $R^{s1}$ is optionally substituted alkyl. In some embodiments, $R^{s1}$ is methyl. In some embodiments, $R^{s1}$ is cyanomethyl. In some embodiments, $R^{s1}$ is nitromethyl. In some embodiments, $R^{s1}$ is optionally substituted aryl. In some embodiments, $R^{s1}$ is optionally substituted phenyl. In some embodiments, $R^{s1}$ is phenyl. In some embodiments, $R^{s1}$ is p-nitrophenyl. In some embodiments, $R^{s1}$ is p-methylphenyl. In some embodiments, $R^{s1}$ is p-chlorophenyl. In some embodiments, $R^{s1}$ is o-chlorophenyl. In some embodiments, $R^{s1}$ is 2,4,6-trichlorophenyl. In some embodiments, $R^{s1}$ is pentafluorophenyl. In some embodiments, $R^{s1}$ is optionally substituted heterocyclyl. In some embodiments, $R^{s1}$ is optionally substituted heteroaryl.

In some embodiments, $R^{s1}$—$S(O)_2S$— is

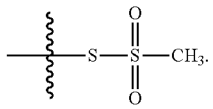

(MTS)

In some embodiments, $R^{s1}$—$S(O)_2S$— is

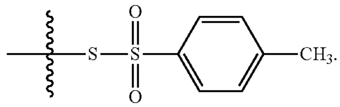

(TTS)

In some embodiments, $R^{s1}$—$S(O)_2S$— is

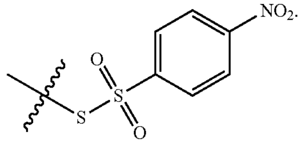

($NO_2$PheTS)

In some embodiments, $R^{s1}$—$S(O)_2S$— is

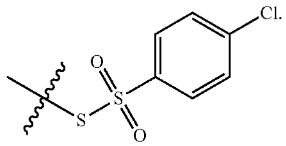

(p-ClPheTS)

In some embodiments, $R^{s1}$—$S(O)_2S$— is

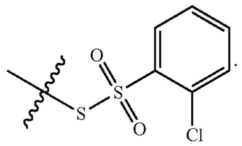

(o-ClPheTS)

In some embodiments, $R^{s1}$—$S(O)_2S$— is

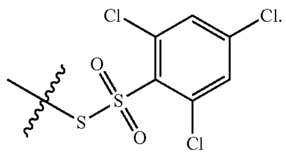

(2,4,6-TriClPheTS)

In some embodiments, $R^{s1}$—S(O)$_2$S— is

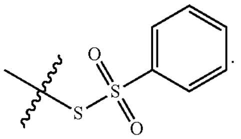

(PheTS)

In some embodiments, $R^{s1}$—S(O)$_2$S— is

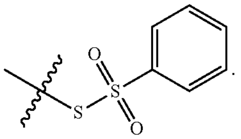

(PFPheTS)

In some embodiments, $R^{s1}$—S(O)$_2$S— is

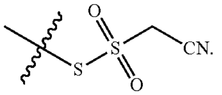

(a-CNMTS)

In some embodiments, $R^{s1}$—S(O)$_2$S— is

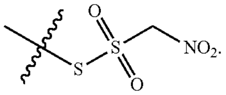

(a-$NO_2$MTS)

In some embodiments, $R^{s1}$—S— is

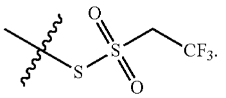

(a-$CF_3$MTS)

In some embodiments, $R^{s1}$—S(O)$_2$S— is

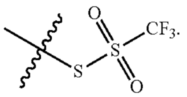

(a-$CF_3$TS)

In some embodiments, $R^{s1}$—S(O)$_2$S— is

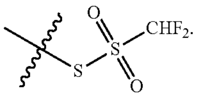

(a-$CHF_2$TS)

In some embodiments, $R^{s1}$—S(O)$_2$S— is

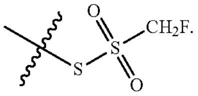

(a-$CH_2$FTS)

In some embodiments, the sulfurizing reagent has the structure of S-I or S-II, wherein L is —S—$R^{L3}$— or —S—C(O)—$R^{L3}$—. In some embodiments, L is —S—$R^{L3}$— or —S—C(O)—$R^{L3}$—, wherein $R^{L3}$ is an optionally substituted $C_1$-$C_6$ alkylene. In some embodiments, L is —S—$R^{L3}$— or —S—C(O)—$R^{L3}$—, wherein $R^{L3}$ is an optionally substituted $C_1$-$C_6$ alkenylene. In some embodiments, L is —S—$R^{L3}$— or —S—C(O)—$R^{L3}$—, wherein $R^{L3}$ is an optionally substituted $C_1$-$C_6$ alkylene wherein one or more methylene units are optionally and independently replaced by an optionally substituted $C_1$-$C_6$ alkenylene, arylene, or heteroarylene. In some embodiments, In some embodiments, $R^{L3}$ is an optionally substituted —S—($C_1$-$C_6$ alkenylene)-, —S—($C_1$-$C_6$ alkylene)-, —S—($C_1$-$C_6$ alkylene)-arylene-($C_1$-$C_6$ alkylene)-, —S—CO-arylene-($C_1$-$C_6$ alkylene)-, or —S—CO—($C_1$-$C_6$ alkylene)-arylene-($C_1$-$C_6$ alkylene)-. In some embodiments, the sulfurizing reagent has the structure of S-I or S-II, wherein L is —S—$R^{L3}$— or —S—C(O)—$R^{L3}$—, and the sulfur atom is connected to $R^1$.

In some embodiments, the sulfurizing reagent has the structure of S-I or S-II, wherein L is alkylene, alkenylene, arylene or heteroarylene.

In some embodiments, the sulfurizing reagent has the structure of S-I or S-IT, wherein L is

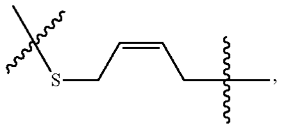

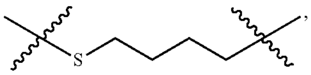

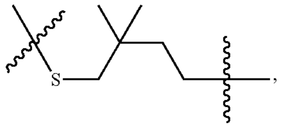

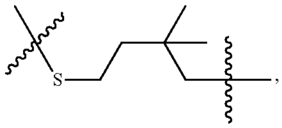

-continued
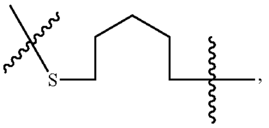
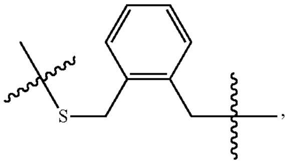
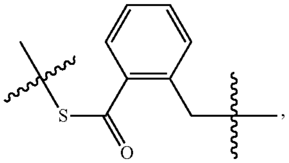
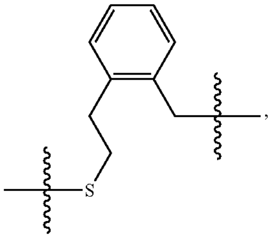
or
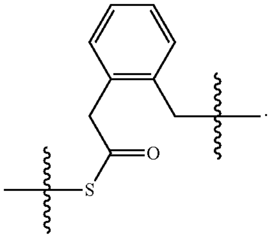
In some embodiments, L is
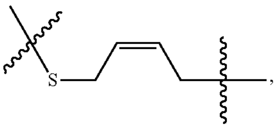
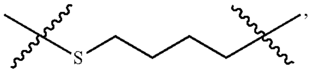
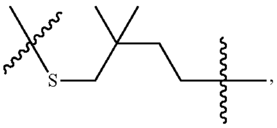
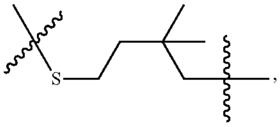
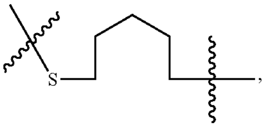
-continued
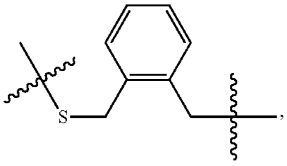
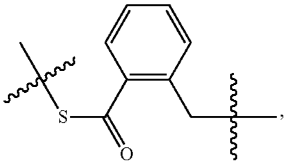
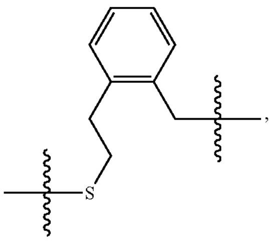
or
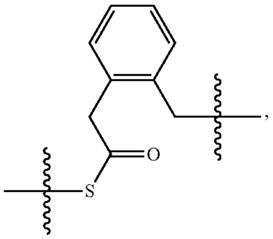
wherein the sulfur atom is connected to $R^1$. In some embodiments, the sulfurizing reagent has the structure of S-I or S-II, wherein $R^1$ is
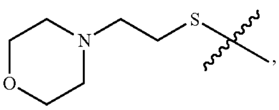
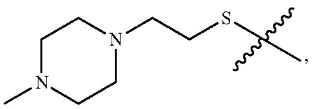
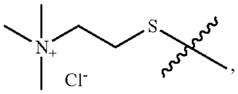
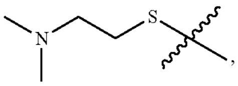
or
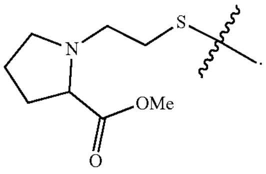

In some embodiments, $R^1$ is

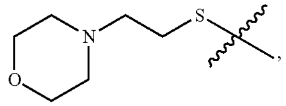
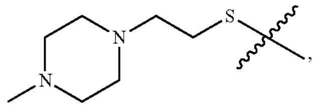
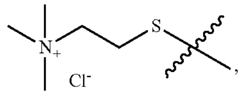
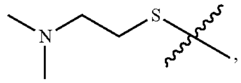
or
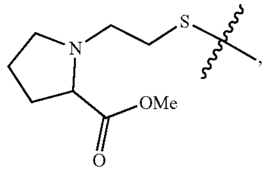

wherein the sulfur atom is connected to L. In some embodiments, the sulfurizing reagent has the structure of S-I or S-II, wherein L is

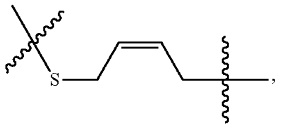
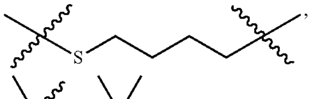
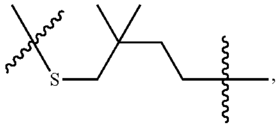
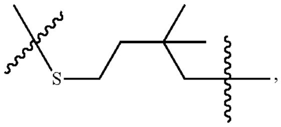
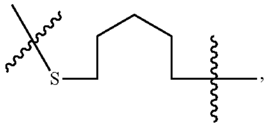
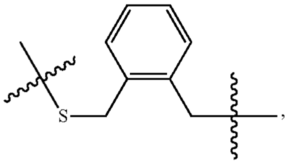
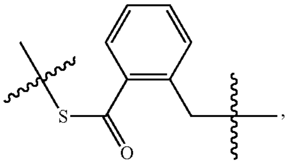

-continued

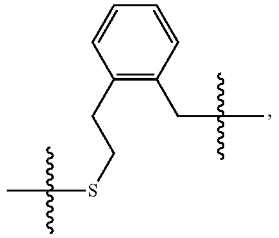
or
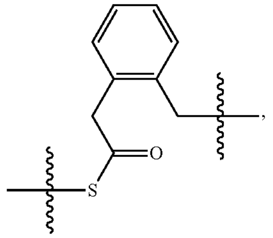

wherein the sulfur atom is connected to $R^1$; and $R^1$ is

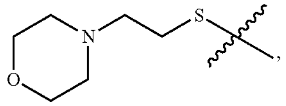
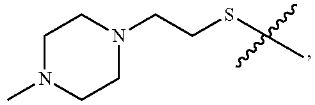
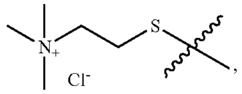
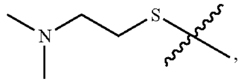
or
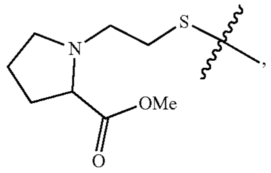

wherein the sulfur atom is connected to L.

In some embodiments, the sulfurizing reagent has the structure of S-I or S-II, wherein $R^1$ is —S—$R^{L2}$, wherein $R^{L2}$ is as defined and described above and herein. In some embodiments, $R^{L2}$ is an optionally substituted group selected from —S—($C_1$-$C_6$ alkylene)-heterocyclyl, —S—($C_1$-$C_6$ alkenylene)-heterocyclyl, —S—($C_1$-$C_6$ alkylene)-N(R')$_2$, —S—($C_1$-$C_6$ alkylene)-N(R')$_3$, wherein each R' is as defined above and described herein.

In some embodiments, -L-$R^1$ is —$R^{L3}$—S—S—$R^{L2}$, wherein each variable is independently as defined above and described herein. In some embodiments, -L-$R^1$ is —$R^{L3}$—C(O)—S—S—$R^{L2}$, wherein each variable is independently as defined above and described herein.

Example bis(thiosulfonate) reagents of formula S-II are depicted below:

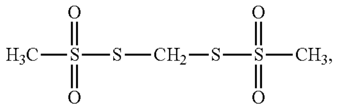

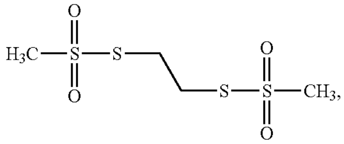

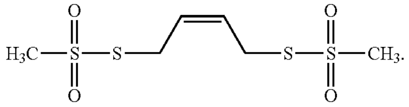

In some embodiments, the sulfurization reagent is a compound having one of the following formulae:

$S_8$, $R^{s2}$—S—S—$R^{s3}$, or $R^{s2}$—S—$X^s$—$R^{s3}$, wherein:

each of $R^{s2}$ and $R^{S3}$ is independently an optionally substituted group selected from aliphatic, aminoalkyl, carbocyclyl, heterocyclyl, heterocycloalkyl, aryl, heteroaryl, alkyloxy, aryloxy, heteroaryloxy, acyl, amide, imide, or thiocarbonyl; or $R^{s2}$ and $R^{S3}$ are taken together with the atoms to which they are bound to form an optionally substituted heterocyclic or heteroaryl ring;

X is —$S(O)_2$—, —O—, or —N(R')—; and

R' is as defined and described above and herein.

In some embodiments, the sulfurization reagent is $S_8$,

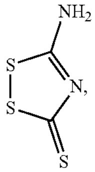

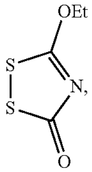

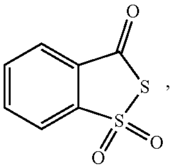

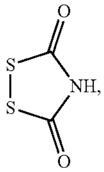

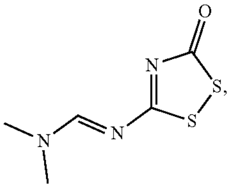

or

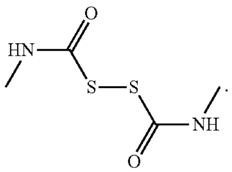

In some embodiments, the sulfurization reagent is $S_8$,

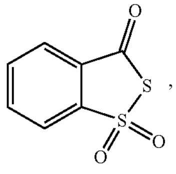

or

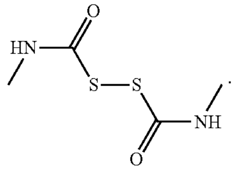

In some embodiments, the sulfurization reagent is

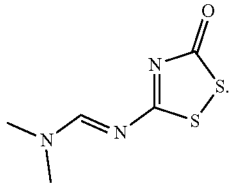

Example sulfuring reagents are depicted in below:

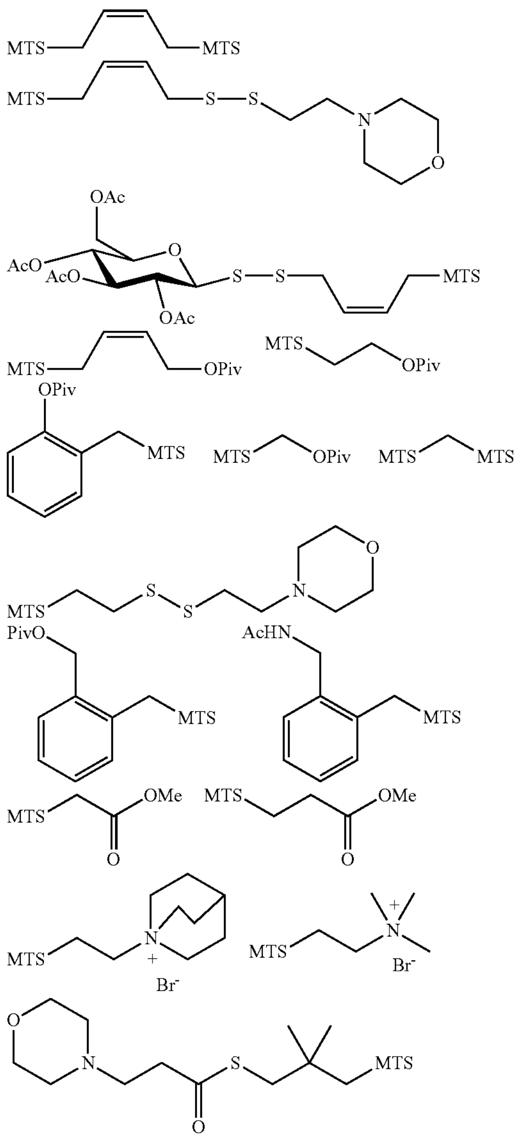

-continued
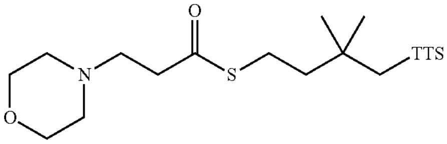
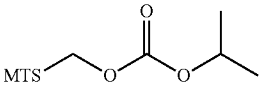
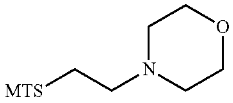
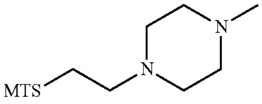
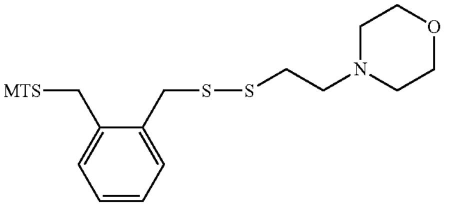
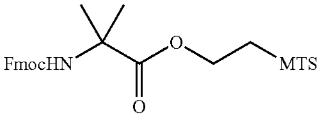
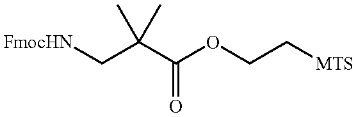
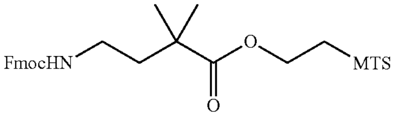
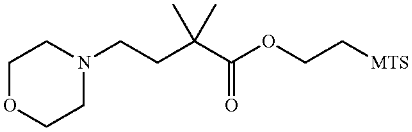
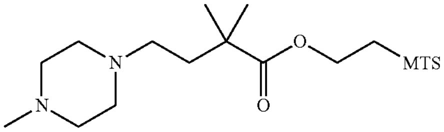
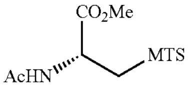
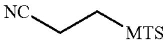
$S_8$
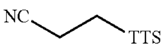
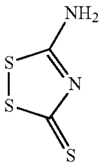
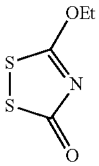
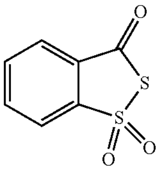
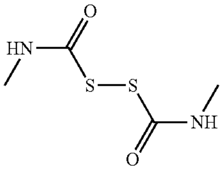
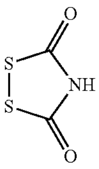
-continued
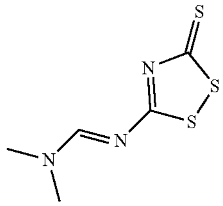
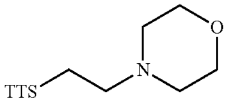
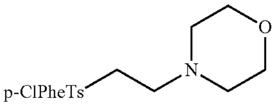
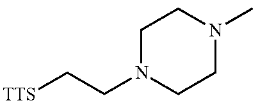
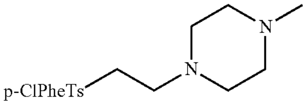
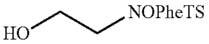
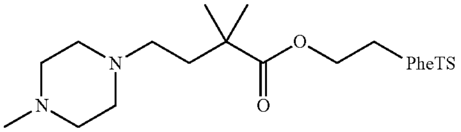
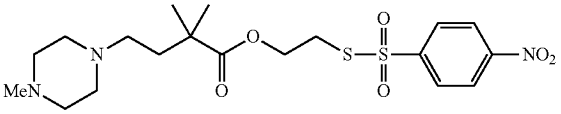
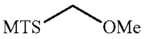
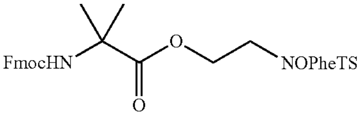
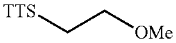
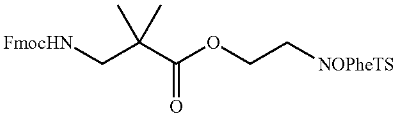
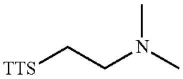
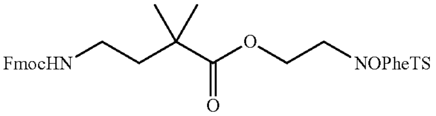
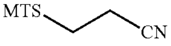
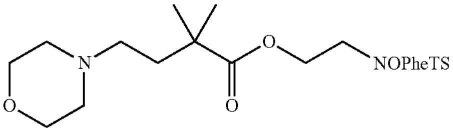
POS
In some embodiments, a provided sulfurization reagent is used to modify an H-phosphonate. For instance, in some embodiments, an H-phosphonate oligonucleotide is synthesized using, e.g., a method of Wada I or Wada II, and is modified using a sulfurization reagent of formula S-I or S-II:

S-I

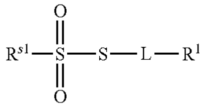

S-II

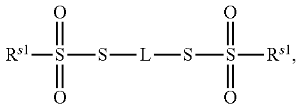

wherein each of $R^{S1}$, L, and $R^1$ are as described and defined above and herein.

In some embodiments, the present disclosure provides a process for synthesizing a phosphorothioate triester, comprising steps of:

i) reacting an H-phosphonate of structure:

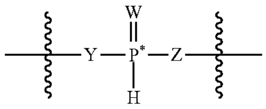

wherein each of W, Y, and Z are as described and defined above and herein, with a silylating reagent to provide a silyloxyphosphonate; and ii) reacting the silyloxyphosphonate with a sulfurization reagent of structure S-I or S-II:

S-I

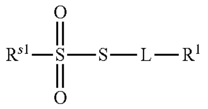

S-II

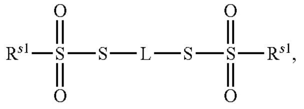

to provide a phosphorothiotriester.

In some embodiments, a selenium electrophile is used instead of a sulfurizing reagent to introduce modification to the internucleotidic linkage. In some embodiments, a selenium electrophile is a compound having one of the following formulae:

Se, $R^{s2}$—Se—Se—$R^{s3}$, or $R^{s2}$—Se—$X^{s}$—$R^{s3}$, wherein:

each of $R^{s2}$ and $R^{S3}$ is independently an optionally substituted group selected from aliphatic, aminoalkyl, carbocyclyl, heterocyclyl, heterocycloalkyl, aryl, heteroaryl, alkyloxy, aryloxy, heteroaryloxy, acyl, amide, imide, or thiocarbonyl; or $R^{s2}$ and $R^{S3}$ are taken together with the atoms to which they are bound to form an optionally substituted heterocyclic or heteroaryl ring;

X is —$S(O)_2$—, —O—, or —N(R')—; and

R' is as defined and described above and herein.

In other embodiments, the selenium electrophile is a compound of Se, KSeCN,

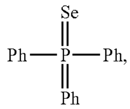,

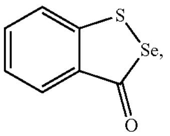,

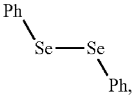, or

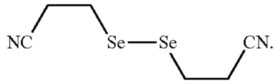.

In some embodiments, the selenium electrophile is Se or

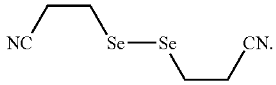.

In some embodiments, a sulfurization reagent for use in accordance with the present disclosure is characterized in that the moiety transferred to phosphorus during sulfurization is a substituted sulfur (e.g., —SR) as opposed to a single sulfur atom (e.g., —S— or =S).

In some embodiments, a sulfurization reagent for use in accordance with the present disclosure is characterized in that the activity of the reagent is tunable by modifying the reagent with a certain electron withdrawing or donating group.

In some embodiments, a sulfurization reagent for use in accordance with the present disclosure is characterized in that it is crystalline. In some embodiments, a sulfurization reagent for use in accordance with the present disclosure is characterized in that it has a high degree of crystallinity. In certain embodiments, a sulfurization reagent for use in accordance with the present disclosure is characterized by ease of purification of the reagent via, e.g., recrystallization. In certain embodiments, a sulfurization reagent for use in accordance with the present disclosure is characterized in that it is substantially free from sulfur-containing impurities. In some embodiments, sulfurization reagents which are substantially free from sulfur-containing impurities show increased efficiency.

In some embodiments, the provided chirally controlled oligonucleotide comprises one or more phosphate diester linkages. To synthesize such chirally controlled oligonucleotides, one or more modifying steps are optionally replaced with an oxidation step to install the corresponding phosphate diester linkages. In some embodiments, the oxidation step is performed in a fashion similar to ordinary oligonucleotide synthesis. In some embodiments, an oxidation step comprises the use of $I_2$. In some embodiments, an oxidation step comprises the use of $I_2$ and pyridine. In some embodiments, an oxidation step comprises the use of 0.02 M $I_2$ in a THF/pyridine/water (70:20:10—v/v/v) co-solvent system. An example cycle is depicted in Scheme I-c.

In some embodiments, a phosphorothioate is directly formed through sulfurization by a sulfurization reagents, e.g., 3-phenyl-1,2,4-dithiazolin-5-one. In some embodiments, after a direct installation of a phosphorothioate, a chiral auxiliary group remains attached to the internucleotidic phosphorus atom. In some embodiments, an additional de-protecting step is required to remove the chiral auxiliary (e.g., for DPSE-type chiral auxiliary, using TBAF, HF-$Et_3N$, etc.).

In some embodiments, a phosphorothioate precursor is used to synthesize chirally controlled oligonucleotides comprising phosphorothioate linkages. In some embodiments, such a phosphorothioate precursor is

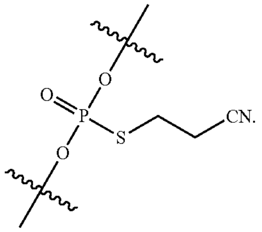

In some embodiments,

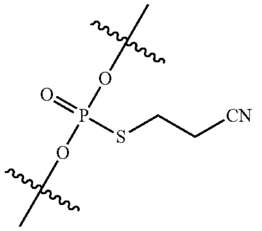

is converted into phosphorothioate diester linkages during standard deprotection/release procedure after cycle exit. Examples are further depicted below.

In some embodiments, the provided chirally controlled oligonucleotide comprises one or more phosphate diester linkages and one or more phosphorothioate diester linkages. In some embodiments, the provided chirally controlled oligonucleotide comprises one or more phosphate diester linkages and one or more phosphorothioate diester linkages, wherein at least one phosphate diester linkage is installed after all the phosphorothioate diester linkages when synthesized from 3' to 5'. To synthesize such chirally controlled oligonucleotides, in some embodiments, one or more modifying steps are optionally replaced with an oxidation step to install the corresponding phosphate diester linkages, and a phosphorothioate precursor is installed for each of the phosphorothioate diester linkages. In some embodiments, a phosphorothioate precursor is converted to a phosphorothioate diester linkage after the desired oligonucleotide length is achieved. In some embodiments, the deprotection/release step during or after cycle exit converts the phosphorothioate precursors into phosphorothioate diester linkages. In some embodiments, a phosphorothioate precursor is characterized in that it has the ability to be removed by a beta-elimination pathway. In some embodiments, a phosphorothioate precursor is

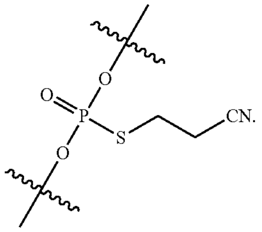

As understood by one of ordinary skill in the art, one of the benefits of using a phosphorothioate precursor, for instance,

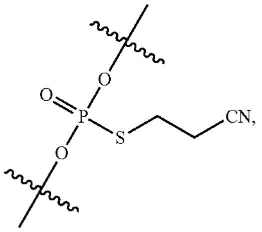

during synthesis is that

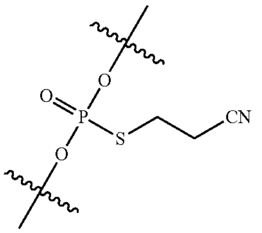

is more stable than phosphorothioate in certain conditions.

In some embodiments, a phosphorothioate precursor is a phosphorus protecting group as described herein, e.g., 2-cyanoethyl (CE or Cne), 2-trimethylsilylethyl, 2-nitroethyl, 2-sulfonylethyl, methyl, benzyl, o-nitrobenzyl, 2-(p-nitrophenyl)ethyl (NPE or Npe), 2-phenylethyl, 3-(N-tert-butylcarboxamido)-1-propyl, 4-oxopentyl, 4-methylthio-1-butyl, 2-cyano-1,1-dimethylethyl, 4-N-methylaminobutyl, 3-(2-pyridyl)-1-propyl, 2-[N-methyl-N-(2-pyridyl)]aminoethyl, 2-(N-formyl,N-methyl)aminoethyl, 4-[N-methyl-N-(2,2,2-trifluoroacetyl)amino]butyl. Examples are further depicted below.

As noted above, in some embodiments, sulfurization occurs under conditions which cleave the chiral reagent from the growing oligonucleotide. In some embodiments, sulfurization occurs under conditions which do not cleave the chiral reagent from the growing oligonucleotide.

In some embodiments, a sulfurization reagent is dissolved in a suitable solvent and delivered to the column. In certain embodiments, the solvent is a polar aprotic solvent such as a nitrile solvent. In some embodiments, the solvent is acetonitrile. In some embodiments, a solution of sulfurization reagent is prepared by mixing a sulfurization reagent (e.g., a thiosulfonate derivative as described herein) with BSTFA (N,O-bis-trimethylsilyl-trifluoroacetamide) in a nitrile solvent (e.g., acetonitrile). In some embodiments, BSTFA is not included. For example, the present inventors have found that relatively more reactive sulfurization reagents of general formula $R^{s2}$—S—$S(O)_2$—$R^{s3}$ can often successfully participate in sulfurization reactions in the absence of BSTFA. To give but one example, the inventors have demonstrated that where $R^{s2}$ is p-nitrophenyl and $R^{S3}$ is methyl then no BSTFA is required. In light of this disclosure, those skilled in the art will readily be able to determine other situations and/or sulfurization reagents that do not require BSTFA.

In some embodiments, the sulfurization step is performed at room temperature. In some embodiments, the sulfurization step is performed at lower temperatures such as about 0° C., about 5° C., about 10° C., or about 15° C. In some embodiments, the sulfurization step is performed at elevated temperatures of greater than about 20° C.

In some embodiments, a sulfurization reaction is run for about 1 minute to about 120 minutes. In some embodiments, a sulfurization reaction is run for about 1 minute to about 90 minutes. In some embodiments, a sulfurization reaction is run for about 1 minute to about 60 minutes. In some embodiments, a sulfurization reaction is run for about 1 minute to about 30 minutes. In some embodiments, a sulfurization reaction is run for about 1 minute to about 25 minutes. In some embodiments, a sulfurization reaction is run for about 1 minute to about 20 minutes. In some embodiments, a sulfurization reaction is run for about 1 minute to about 15 minutes. In some embodiments, a sulfurization reaction is run for about 1 minute to about 10 minutes. In some embodiments, a sulfurization reaction is run for about 5 minute to about 60 minutes.

In some embodiments, a sulfurization reaction is run for about 5 minutes. In some embodiments, a sulfurization reaction is run for about 10 minutes. In some embodiments, a sulfurization reaction is run for about 15 minutes. In some embodiments, a sulfurization reaction is run for about 20 minutes. In some embodiments, a sulfurization reaction is run for about 25 minutes. In some embodiments, a sulfurization reaction is run for about 30 minutes. In some embodiments, a sulfurization reaction is run for about 35 minutes. In some embodiments, a sulfurization reaction is run for about 40 minutes. In some embodiments, a sulfurization reaction is run for about 45 minutes. In some embodiments, a sulfurization reaction is run for about 50 minutes. In some embodiments, a sulfurization reaction is run for about 55 minutes. In some embodiments, a sulfurization reaction is run for about 60 minutes.

It was unexpectedly found that certain of the sulfurization modification products made in accordance with methods of the present disclosure are unexpectedly stable. In some embodiments, it the unexpectedly stable products are phosphorothioate triesters. In some embodiments, the unexpectedly stable products are chirally controlled oligonucleotides comprising one or more internucleotidic linkages having the structure of formula I-c.

One of skill in the relevant arts will recognize that sulfurization methods described herein and sulfurization reagents described herein are also useful in the context of modifying H-phosphonate oligonucleotides such as those described in Wada II (WO2010/064146).

In some embodiments, the sulfurization reaction has a stepwise sulfurization efficiency that is at least about 80%, 85%, 90%, 95%, 96%, 97%, or 98%. In some embodiments, the sulfurization reaction provides a crude dinucleotide product composition that is at least 98% pure. In some embodiments, the sulfurization reaction provides a crude tetranucleotide product composition that is at least 90% pure. In some embodiments, the sulfurization reaction provides a crude dodecanucleotide product composition that is at least 70% pure. In some embodiments, the sulfurization reaction provides a crude icosanucleotide product composition that is at least 50% pure.

Once the step of modifying the linkage phosphorus is complete, the oligonucleotide undergoes another deblock step in preparation for re-entering the cycle. In some embodiments, a chiral auxiliary remains intact after sulfurization and is deblocked during the subsequent deblock step, which necessarily occurs prior to re-entering the cycle. The process of deblocking, coupling, capping, and modifying, are repeated until the growing oligonucleotide reaches a desired length, at which point the oligonucleotide can either be immediately cleaved from the solid support or left attached to the support for purification purposes and later cleaved. In some embodiments, one or more protecting groups are present on one or more of the nucleotide bases, and cleavage of the oligonucleotide from the support and deprotection of the bases occurs in a single step. In some embodiments, one or more protecting groups are present on one or more of the nucleotide bases, and cleavage of the oligonucleotide from the support and deprotection of the bases occurs in more than one step. In some embodiments, deprotection and cleavage from the support occurs under basic conditions using, e.g., one or more amine bases. In certain embodiments, the one or more amine bases comprise propyl amine. In certain embodiments, the one or more amine bases comprise pyridine.

In some embodiments, cleavage from the support and/or deprotection occurs at elevated temperatures of about 30° C. to about 90° C. In some embodiments, cleavage from the support and/or deprotection occurs at elevated temperatures of about 40° C. to about 80° C. In some embodiments, cleavage from the support and/or deprotection occurs at elevated temperatures of about 50° C. to about 70° C. In some embodiments, cleavage from the support and/or deprotection occurs at elevated temperatures of about 60° C. In some embodiments, cleavage from the support and/or deprotection occurs at ambient temperatures.

Example purification procedures are described herein and/or are known generally in the relevant arts.

Noteworthy is that the removal of the chiral auxiliary from the growing oligonucleotide during each cycle is beneficial for at least the reasons that (1) the auxiliary will not have to be removed in a separate step at the end of the oligonucleotide synthesis when potentially sensitive functional groups are installed on phosphorus; and (2) unstable phosphorus-auxiliary intermediates prone to undergoing side reactions and/or interfering with subsequent chemistry are avoided. Thus, removal of the chiral auxiliary during each cycle makes the overall synthesis more efficient.

While the step of deblocking in the context of the cycle is described above, additional general methods are included below.

Deblocking Step

In some embodiments, the step of coupling is preceded by a step of deblocking. For instance, in some embodiments, the 5' hydroxyl group of the growing oligonucleotide is blocked (i.e., protected) and must be deblocked in order to subsequently react with a nucleoside coupling partner.

In some embodiments, acidification is used to remove a blocking group. In some embodiments, the acid is a Brønsted acid or Lewis acid. Useful Brønsted acids are carboxylic acids, alkylsulfonic acids, arylsulfonic acids, phosphoric acid and its derivatives, phosphonic acid and its derivatives, alkylphosphonic acids and their derivatives, arylphosphonic acids and their derivatives, phosphinic acid, dialkylphosphinic acids, and diarylphosphinic acids which have a pKa (25° C. in water) value of −0.6 (trifluoroacetic acid) to 4.76 (acetic acid) in an organic solvent or water (in the case of 80% acetic acid). The concentration of the acid (1 to 80%) used in the acidification step depends on the acidity of the acid. Consideration to the acid strength must be taken into account as strong acid conditions will result in depurination/depyrimidination, wherein purinyl or pyrimidinyl bases are cleaved from ribose ring and or other sugar ring. In some embodiments, an acid is selected from $R^{a1}COOH$, $R^{a1}SO_3H$,

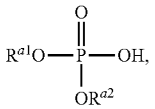 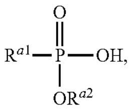 or 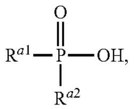

wherein each of $R^{a1}$ and $R^{a2}$ is independently hydrogen or an optionally substituted alkyl or aryl, and $R^{a3}$ is an optionally substituted alkyl or aryl.

In some embodiments, acidification is accomplished by a Lewis acid in an organic solvent. Examples of such useful Lewis acids are $Zn(X^a)_2$ wherein $X^a$ is Cl, Br, I, or $CF_3SO_3$.

In some embodiments, the step of acidifying comprises adding an amount of a Brønsted or Lewis acid effective to remove a blocking group without removing purine moieties from the condensed intermediate.

Acids that are useful in the acidifying step also include, but are not limited to 10% phosphoric acid in an organic solvent, 10% hydrochloric acid in an organic solvent, 1% trifluoroacetic acid in an organic solvent, 3% dichloroacetic acid or trichloroacetic acid in an organic solvent or 80% acetic acid in water. The concentration of any Brønsted or Lewis acid used in this step is selected such that the concentration of the acid does not exceed a concentration that causes cleavage of a nucleobase from a sugar moiety.

In some embodiments, acidification comprises adding 1% trifluoroacetic acid in an organic solvent. In some embodiments, acidification comprises adding about 0.1% to about 8% trifluoroacetic acid in an organic solvent. In some embodiments, acidification comprises adding 3% dichloroacetic acid or trichloroacetic acid in an organic solvent. In some embodiments, acidification comprises adding about 0.1% to about 10% dichloroacetic acid or trichloroacetic acid in an organic solvent. In some embodiments, acidification comprises adding 3% trichloroacetic acid in an organic solvent. In some embodiments, acidification comprises adding about 0.1% to about 10% trichloroacetic acid in an organic solvent. In some embodiments, acidification comprises adding 80% acetic acid in water. In some embodiments, acidification comprises adding about 50% to about 90%, or about 50% to about 80%, about 50% to about 70%, about 50% to about 60%, about 70% to about 90% acetic acid in water. In some embodiments, the acidification comprises the further addition of cation scavengers to an acidic solvent. In certain embodiments, the cation scavengers can be triethylsilane or triisopropylsilane. In some embodiments, a blocking group is deblocked by acidification, which comprises adding 1% trifluoroacetic acid in an organic solvent. In some embodiments, a blocking group is deblocked by acidification, which comprises adding 3% dichloroacetic acid in an organic solvent. In some embodiments, a blocking group is deblocked by acidification, which comprises adding 3% trichloroacetic acid in an organic solvent. In some embodiments, a blocking group is deblocked by acidification, which comprises adding 3% trichloroacetic acid in dichloromethane.

In certain embodiments, methods of the present disclosure are completed on a synthesizer and the step of deblocking the hydroxyl group of the growing oligonucleotide comprises delivering an amount solvent to the synthesizer column, which column contains a solid support to which the oligonucleotide is attached. In some embodiments, the solvent is a halogenated solvent (e.g., dichloromethane). In certain embodiments, the solvent comprises an amount of an acid. In some embodiments, the solvent comprises an amount of an organic acid such as, for instance, trichloroacetic acid. In certain embodiments, the acid is present in an amount of about 1% to about 20% w/v. In certain embodiments, the acid is present in an amount of about 1% to about 10% w/v. In certain embodiments, the acid is present in an amount of about 1% to about 5% w/v. In certain embodiments, the acid is present in an amount of about 1 to about 3% w/v. In certain embodiments, the acid is present in an amount of about 3% w/v. Methods for deblocking a hydroxyl group are described further herein. In some embodiments, the acid is present in 3% w/v is dichloromethane.

In some embodiments, the chiral auxiliary is removed before the deblocking step. In some embodiments, the chiral auxiliary is removed during the deblocking step.

In some embodiments, cycle exit is performed before the deblocking step. In some embodiments, cycle exit is preformed after the deblocking step.

General Conditions for Blocking Group/Protecting Group Removal

Functional groups such as hydroxyl or amino moieties which are located on nucleobases or sugar moieties are routinely blocked with blocking (protecting) groups (moieties) during synthesis and subsequently deblocked. In general, a blocking group renders a chemical functionality of a molecule inert to specific reaction conditions and can later be removed from such functionality in a molecule without substantially damaging the remainder of the molecule (see e.g., Green and Wuts, Protective Groups in Organic Synthesis, 2nd Ed., John Wiley & Sons, New York, 1991). For example, amino groups can be blocked with nitrogen blocking groups such as phthalimido, 9-fludrenylmethoxycarbonyl (FMOC), triphenylmethylsulfenyl, t-BOC, 4,4'-dimethoxytrityl (DMTr), 4-methoxytrityl (MMTr), 9-phenylxanthin-9-yl (Pixyl), trityl (Tr), or 9-(p-methoxyphenyl)xanthin-9-yl (MOX). Carboxyl groups can be protected as acetyl groups. Hydroxy groups can be protected such as tetrahydropyranyl (THP), t-butyldimethylsilyl (TBDMS), 1-[(2-chloro-4-methyl)phenyl]-4-methoxypiperidin-4-yl (Ctmp), 1-(2-fluorophenyl)-4-methoxypiperidin-4-yl (Fpmp), 1-(2-chloroethoxy)ethyl, 3-methoxy-1,5-dicarbomethoxypentan-3-yl (MDP), bis(2-acetoxyethoxy)methyl (ACE), triisopropylsilyloxymethyl (TOM), 1-(2-cyanoethoxy)ethyl (CEE), 2-cyanoethoxymethyl (CEM), [4-(N-dichloroacetyl-N-methylamino)benzyloxy]methyl, 2-cyanoethyl (CN), pivaloyloxymethyl (PivOM), levunyloxymethyl (ALE). Other representative hydroxyl blocking groups have been described (see e.g., Beaucage et al., Tetrahedron, 1992, 46, 2223). In some embodiments, hydroxyl blocking groups are acid-labile groups, such as the trityl, monomethoxytrityl, dimethoxytrityl, trimethoxytrityl, 9-phenylxanthin-9-yl (Pixyl) and 9-(p-methoxyphenyl)xanthin-9-yl (MOX). Chemical functional groups can also be blocked by including them in a precursor form. Thus an azido group can be considered a blocked form of an amine as the azido group is easily converted to the amine. Further representative protecting groups utilized in nucleic acid synthesis are known (see e.g. Agrawal et al., Protocols for Oligonucleotide Conjugates, Eds., Humana Press, New Jersey, 1994, Vol. 26, pp. 1-72).

Various methods are known and used for removal of blocking groups from nucleic acids. In some embodiments, all blocking groups are removed. In some embodiments, a portion of blocking groups are removed. In some embodiments, reaction conditions can be adjusted to selectively remove certain blocking groups.

In some embodiments, nucleobase blocking groups, if present, are cleavable with an acidic reagent after the assembly of a provided oligonucleotide. In some embodiment, nucleobase blocking groups, if present, are cleavable under neither acidic nor basic conditions, e.g. cleavable with fluoride salts or hydrofluoric acid complexes. In some embodiments, nucleobase blocking groups, if present, are cleavable in the presence of base or a basic solvent after the assembly of a provided oligonucleotide. In certain embodiments, one or more of the nucleobase blocking groups are characterized in that they are cleavable in the presence of base or a basic solvent after the assembly of a provided oligonucleotide but are stable to the particular conditions of one or more earlier deprotection steps occurring during the assembly of the provided oligonucleotide.

In some embodiments, blocking groups for nucleobases are not required. In some embodiments, blocking groups for nucleobases are required. In some embodiments, certain nucleobases require one or more blocking groups while other nucleobases do not require one or more blocking groups.

In some embodiments, the oligonucleotide is cleaved from the solid support after synthesis. In some embodiments, cleavage from the solid support comprises the use of propylamine. In some embodiments, cleavage from the solid support comprises the use of propylamine in pyridine. In some embodiments, cleavage from the solid support comprises the use of 20% propylamine in pyridine. In some embodiments, cleavage from the solid support comprises the use of propylamine in anhydrous pyridine. In some embodiments, cleavage from the solid support comprises the use of 20% propylamine in anhydrous pyridine. In some embodiments, cleavage from the solid support comprises use of a polar aprotic solvent such as acetonitrile, NMP, DMSO, sulfone, and/or lutidine. In some embodiments, cleavage from the solid support comprises use of solvent, e.g., a polar aprotic solvent, and one or more primary amines (e.g., a $C_{1-10}$ amine), and/or one or more of methoxylamine, hydrazine, and pure anhydrous ammonia.

In some embodiments, deprotection of oligonucleotide comprises the use of propylamine. In some embodiments, deprotection of oligonucleotide comprises the use of propylamine in pyridine. In some embodiments, deprotection of oligonucleotide comprises the use of 20% propylamine in pyridine. In some embodiments deprotection of oligonucleotide comprises the use of propylamine in anhydrous pyridine. In some embodiments, deprotection of oligonucleotide comprises the use of 20% propylamine in anhydrous pyridine.

In some embodiments, the oligonucleotide is deprotected during cleavage.

In some embodiments, cleavage of oligonucleotide from solid support, or deprotection of oligonucleotide, is performed at about room temperature. In some embodiments, cleavage of oligonucleotide from solid support, or deprotection of oligonucleotide, is performed at elevated temperature. In some embodiments, cleavage of oligonucleotide from solid support, or deprotection of oligonucleotide, is performed at above about 30° C., 40° C., 50° C., 60° C., 70° C., 80° C. 90° C. or 100° C. In some embodiments, cleavage of oligonucleotide from solid support, or deprotection of oligonucleotide, is performed at about 30° C., 40° C., 50° C., 60° C., 70° C., 80° C. 90° C. or 100° C. In some embodiments, cleavage of oligonucleotide from solid support, or deprotection of oligonucleotide, is performed at about 40-80° C. In some embodiments, cleavage of oligonucleotide from solid support, or deprotection of oligonucleotide, is performed at about 50-70° C. In some embodiments, cleavage of oligonucleotide from solid support, or deprotection of oligonucleotide, is performed at about 60° C.

In some embodiments, cleavage of oligonucleotide from solid support, or deprotection of oligonucleotide, is performed for more than 0.1 hr, 1 hr, 2 hrs, 5 hrs, 10 hrs, 15 hrs, 20 hrs, 24 hrs, 30 hrs, or 40 hrs. In some embodiments, cleavage of oligonucleotide from solid support, or deprotection of oligonucleotide, is performed for about 0.1-5 hrs. In some embodiments, cleavage of oligonucleotide from solid support, or deprotection of oligonucleotide, is performed for about 3-10 hrs. In some embodiments, cleavage of oligonucleotide from solid support, or deprotection of oligonucleotide, is performed for about 5-15 hrs. In some embodiments, cleavage of oligonucleotide from solid support, or deprotection of oligonucleotide, is performed for about 10-20 hrs. In some embodiments, cleavage of oligonucleotide from solid support, or deprotection of oligonucleotide, is performed for about 15-25 hrs. In some embodiments, cleavage of oligonucleotide from solid support, or deprotection of oligonucleotide, is performed for about 20-40 hrs. In some embodiments, cleavage of oligonucleotide from solid support, or deprotection of oligonucleotide, is performed for about 2 hrs. In some embodiments, cleavage of oligonucleotide from solid support, or deprotection of oligonucleotide, is performed for about 5 hrs. In some embodiments, cleavage of oligonucleotide from solid support, or deprotection of oligonucleotide, is performed for about 10 hrs. In some embodiments, cleavage of oligonucleotide from solid support, or deprotection of oligonucleotide, is performed for about 15 hrs. In some embodiments, cleavage of oligonucleotide from solid support, or deprotection of oligonucleotide, is performed for about 18 hrs. In some embodiments, cleavage of oligonucleotide from solid support, or deprotection of oligonucleotide, is performed for about 24 hrs.

In some embodiments, cleavage of oligonucleotide from solid support, or deprotection of oligonucleotide, is performed at room temperature for more than 0.1 hr, 1 hr, 2 hrs, 5 hrs, 10 hrs, 15 hrs, 20 hrs, 24 hrs, 30 hrs, or 40 hrs. In some embodiments, cleavage of oligonucleotide from solid support, or deprotection of oligonucleotide, is performed at room temperature for about 5-48 hrs. In some embodiments, cleavage of oligonucleotide from solid support, or deprotection of oligonucleotide, is performed at room temperature for about 10-24 hrs. In some embodiments, cleavage of oligonucleotide from solid support, or deprotection of oligonucleotide, is performed at room temperature for about 18 hrs. In some embodiments, cleavage of oligonucleotide from solid support, or deprotection of oligonucleotide, is performed at elevated temperature for more than 0.1 hr, 1 hr, 2 hrs, 5 hrs, 10 hrs, 15 hrs, 20 hrs, 24 hrs, 30 hrs, or 40 hrs. In some embodiments, cleavage of oligonucleotide from solid support, or deprotection of oligonucleotide, is performed at elevated temperature for about 0.5-5 hrs. In some embodiments, cleavage of oligonucleotide from solid support, or deprotection of oligonucleotide, is performed at about 60° C. for about 0.5-5 hrs. In some embodiments, cleavage of oligonucleotide from solid support, or deprotection of oligonucleotide, is performed at about 60° C. for about 2 hrs.

In some embodiments, cleavage of oligonucleotide from solid support, or deprotection of oligonucleotide comprises the use of propylamine and is performed at room temperature or elevated temperature for more than 0.1 hr, 1 hr, 2 hrs, 5 hrs, 10 hrs, 15 hrs, 20 hrs, 24 hrs, 30 hrs, or 40 hrs. Example conditions are 20% propylamine in pyridine at room temperature for about 18 hrs, and 20% propylamine in pyridine at 60° C. for about 18 hrs.

In some embodiments, prior to cleavage from solid support, a step is performed to remove a chiral auxiliary group, if one is still attached to an internucleotidic phosphorus atom. In some embodiments, for example, one or more DPSE type chiral auxiliary groups remain attached to internucleotidic phosphorus atoms during the oligonucleotide synthesis cycle. Suitable conditions for removing remaining chiral auxiliary groups are widely known in the art, e.g., those described in Wada I, Wada II, Wada III, Chiral Control, etc. In some embodiments, a condition for removing DPSE type chiral auxiliary is TBAF or $HF\text{-}Et_3N$, e.g., 0.1M TBAF in MeCN, 0.5M $HF\text{-}Et_3N$ in THF or MeCN, etc. In some embodiments, the present disclosure recognizes that a linker may be cleaved during the process of removing a chiral auxiliary group. In some embodiments, the present disclosure provides linkers, such as the SP linker, that provides better stability during chiral auxiliary group removal. Among other things, certain linkers provided by the present disclosure provided improved yield and/or purity.

In some embodiments, an activator is a "Wada" activator, i.e., the activator is from any one of Wada I, II, or III documents cited above.

Example activating groups are depicted below:

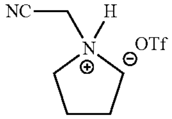

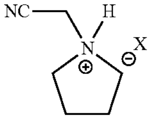

X = non nucleophilic anion

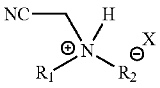

X = $^{-}OTf$, $BF_4^-$, $PF6^-$, $TfN^-$

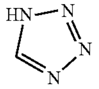

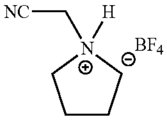

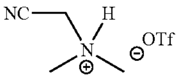

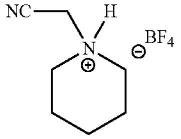

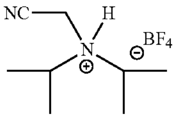

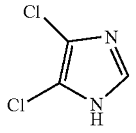

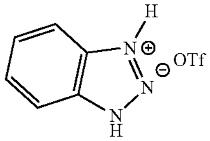

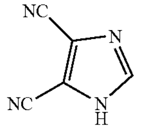

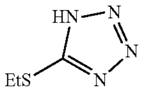

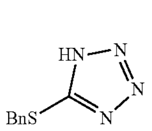

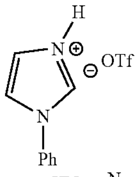

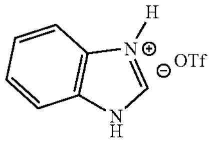

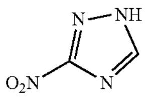

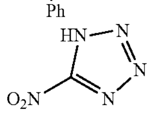

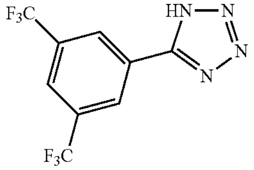

In some embodiments, an activating reagent is selected from

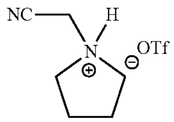

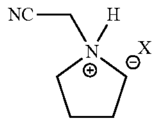

X = non nucleophilic anion

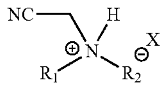

X = $^{-}OTf$, $BF_4^-$, $PF6^-$, $TfN^-$

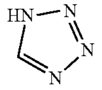

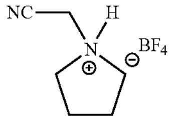

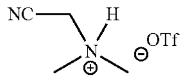

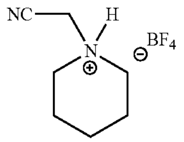

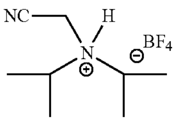

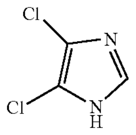

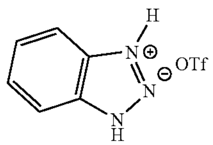

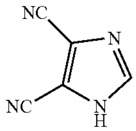

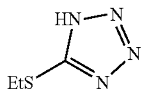

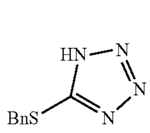

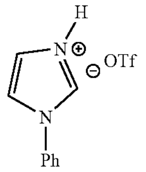

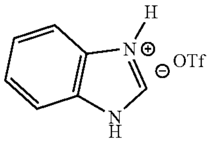

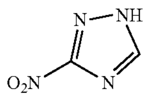

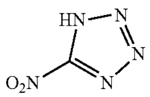

In some embodiments, an example cycle is depicted in Scheme I-b.
Scheme I-b. Installation of phosphorothioate linkages.
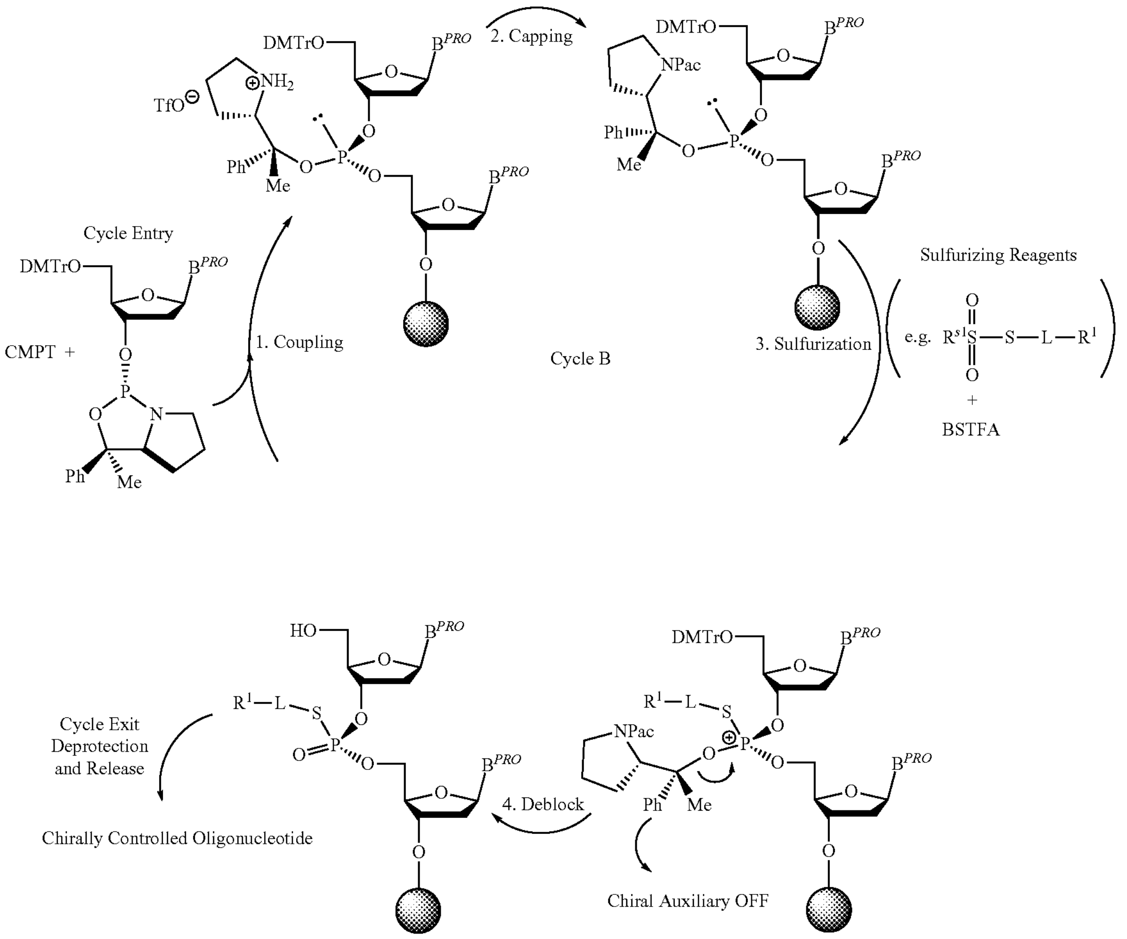
In some embodiments, an example cycle is illustrated in Scheme I-c.
Scheme I-c. Installation of both phosphate diester and modified internucleotidic linkages in a chirally controlled oligonucleotide.
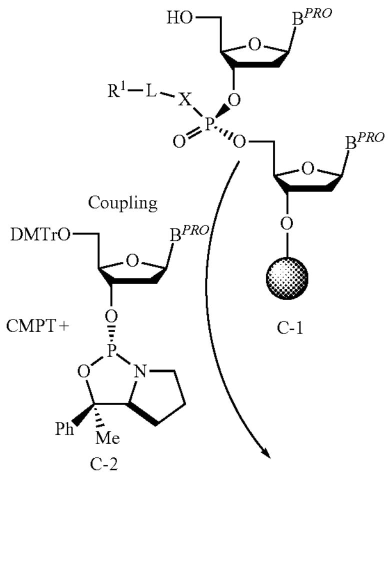

-continued
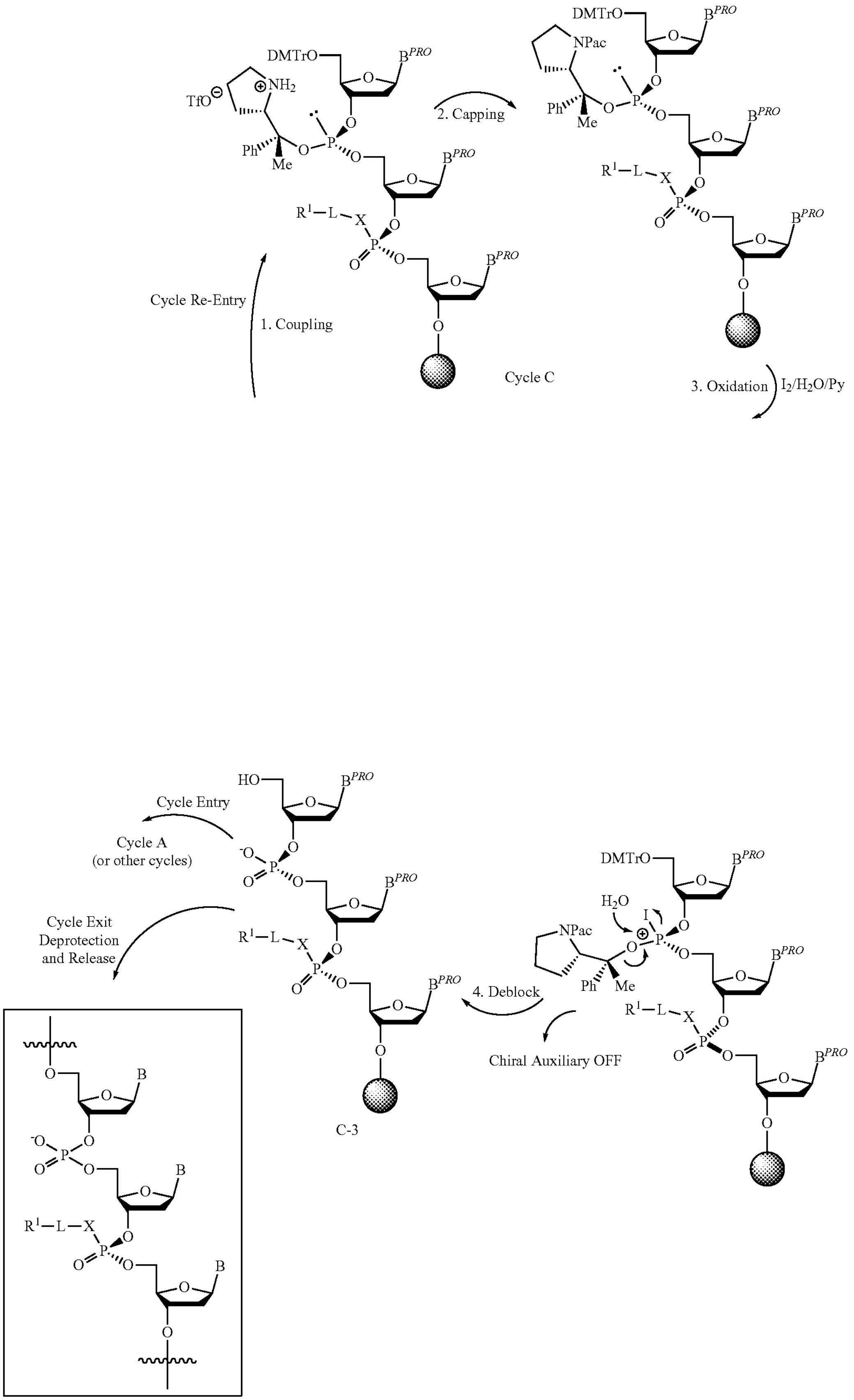

-continued

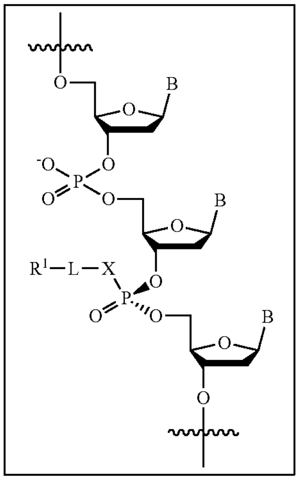

In Scheme I-c, oligonucleotide (or nucleotide, or oligonucleotide with modified internucleotidic linkage) on solid support (C-1) is coupled with phosphoramidite C-2. After coupling and capping, an oxidation step is performed. After deblocking, a phosphate diester linkage is formed. The cycle product C-3 can either re-enter cycle C to install more phosphate diester linkage, or enter other cycles to install other types of internucleotidic linkages, or go to cycle exit.

In some embodiments, non-chirally pure phosphoramidite can be used instead of C-2 in Scheme I-c. In some embodiments, β-cyanoethylphosphoramidites protected with DMTr is used. In some embodiments, the phosphoramidite being used has the structure of

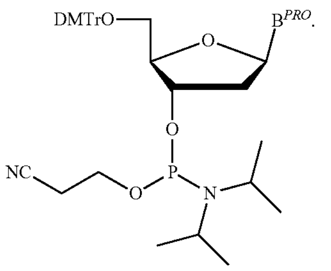

In some embodiments, the use of a phosphorothioate diester precursor increases the stability of oligonucleotide during synthesis. In some embodiments, the use of a phosphorothioate diester precursor improves the efficiency of chirally controlled oligonucleotide synthesis. In some embodiments, the use of a phosphorothioate diester precursor improves the yield of chirally controlled oligonucleotide synthesis. In some embodiments, the use of a phosphorothioate diester precursor improves the product purity of chirally controlled oligonucleotide synthesis.

In some embodiments, the phosphorothioate diester precursor in the above-mentioned methods is

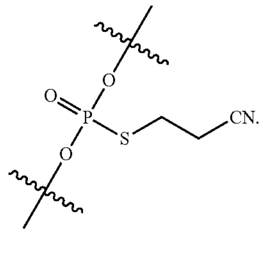

In some embodiments,

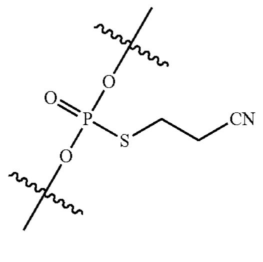

is converted to a phosphorothioate diester linkage during deprotection/release. In some embodiments, an example cycle is depicted in Scheme I-d. More examples are depicted below.

Scheme I-d. Phosphorothioate diester precursor in chirally controlled oligonucleotide synthesis.
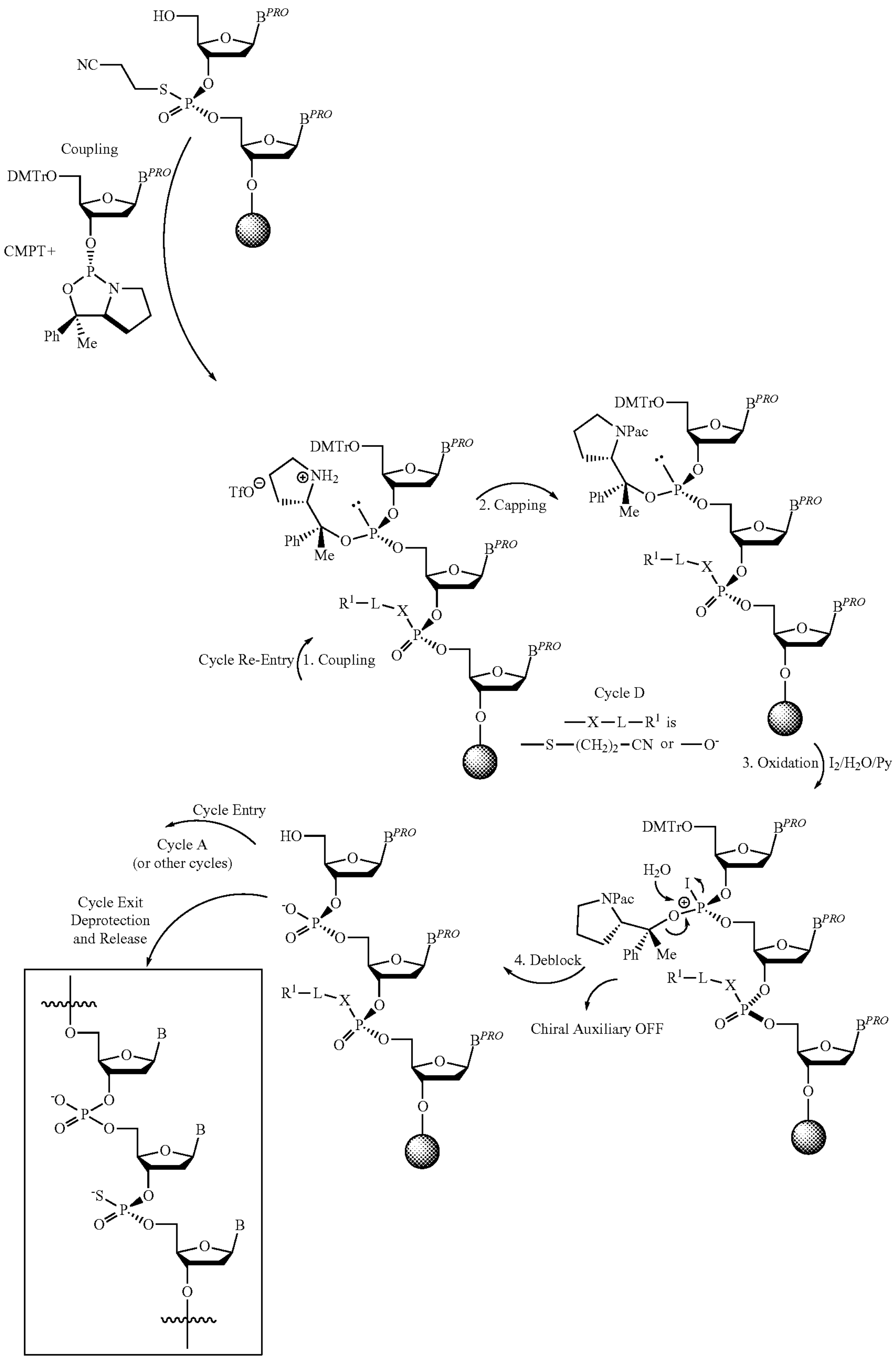

As illustrated in Scheme I-d, both phosphorothioate and phosphate diester linkages can be incorporated into the same chirally controlled oligonucleotide. As understood by a person of ordinary skill in the art, the provided methods do not require that the phosphorothioate diester and the phosphate diester to be consecutive—other internucleotidic linkages can form between them using a cycle as described above. In Scheme I-d, phosphorothioate diester precursors,

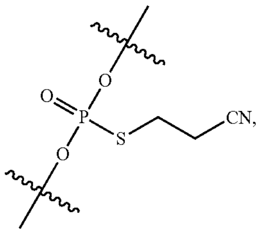

are installed in place of the phosphorothioate diester linkages. In some embodiments, such replacement provided increased synthesis efficiency during certain steps, for instance, the oxidation step. In some embodiments, the use of phosphorothioate diester precursors generally improve the stability of chirally controlled oligonucleotides during synthesis and/or storage. After cycle exit, during deprotection/release, the phosphorothioate diester precursor is converted to phosphorothioate diester linkage. In some embodiments, it is beneficial to use phosphorothioate diester precursor even when no phosphate diester linkage is present in the chirally controlled oligonucleotide, or no oxidation step is required during synthesis.

As in Scheme I-c, in some embodiments, non-chirally pure phosphoramidite can be used for cycles comprising oxidation steps. In some embodiments, β-cyanoethylphosphoramidites protected with DMTr is used. In some embodiments, the phosphoramidite being used has the structure of

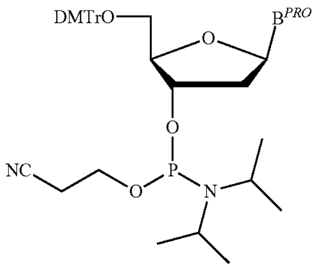

In some embodiments, methods of the present disclosure provide chirally controlled oligonucleotide compositions that are enriched in a particular oligonucleotide type.

In some embodiments, at least about 10% of a provided crude composition is of a particular oligonucleotide type. In some embodiments, at least about 20% of a provided crude composition is of a particular oligonucleotide type. In some embodiments, at least about 30% of a provided crude composition is of a particular oligonucleotide type. In some embodiments, at least about 40% of a provided crude composition is of a particular oligonucleotide type. In some embodiments, at least about 50% of a provided crude composition is of a particular oligonucleotide type. In some embodiments, at least about 60% of a provided crude composition is of a particular oligonucleotide type. In some embodiments, at least about 70% of a provided crude composition is of a particular oligonucleotide type. In some embodiments, at least about 80% of a provided crude composition is of a particular oligonucleotide type. In some embodiments, at least about 90% of a provided crude composition is of a particular oligonucleotide type. In some embodiments, at least about 95% of a provided crude composition is of a particular oligonucleotide type.

In some embodiments, at least about 1% of a provided composition is of a particular oligonucleotide type. In some embodiments, at least about 2% of a provided composition is of a particular oligonucleotide type. In some embodiments, at least about 3% of a provided composition is of a particular oligonucleotide type. In some embodiments, at least about 4% of a provided composition is of a particular oligonucleotide type. In some embodiments, at least about 5% of a provided composition is of a particular oligonucleotide type. In some embodiments, at least about 10% of a provided composition is of a particular oligonucleotide type. In some embodiments, at least about 20% of a provided composition is of a particular oligonucleotide type. In some embodiments, at least about 30% of a provided composition is of a particular oligonucleotide type. In some embodiments, at least about 40% of a provided composition is of a particular oligonucleotide type. In some embodiments, at least about 50% of a provided composition is of a particular oligonucleotide type. In some embodiments, at least about 60% of a provided composition is of a particular oligonucleotide type. In some embodiments, at least about 70% of a provided composition is of a particular oligonucleotide type. In some embodiments, at least about 80% of a provided composition is of a particular oligonucleotide type. In some embodiments, at least about 90% of a provided composition is of a particular oligonucleotide type. In some embodiments, at least about 95% of a provided composition is of a particular oligonucleotide type.

In some embodiments, an example cycle is depicted in Scheme I-e, below.

Scheme I-e. Example cycle using PhMe chiral auxiliary.

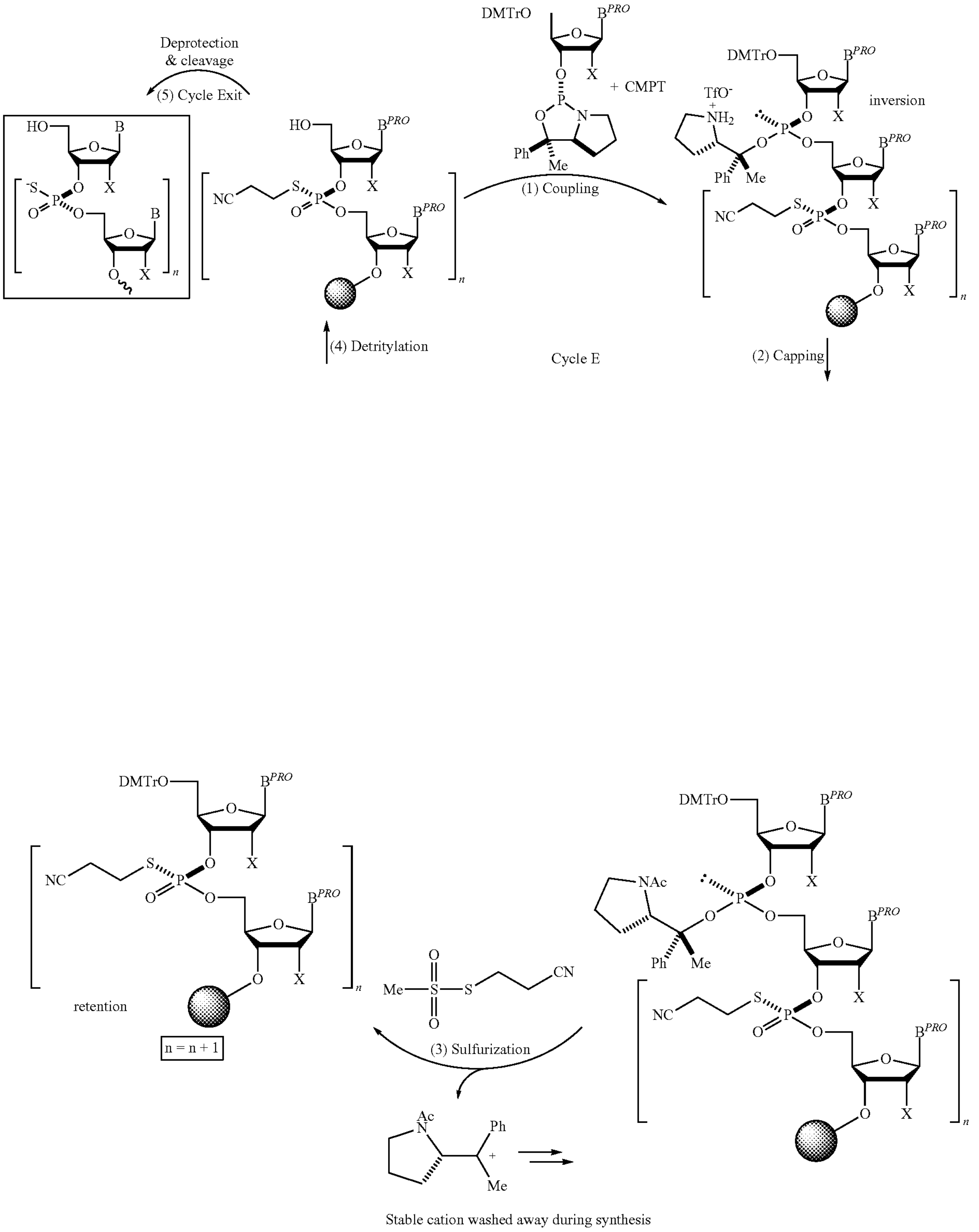

In some embodiments, X is H or a 2'-modification. In some embodiments, X is H or —$OR^1$, wherein $R'$ is not hydrogen. In some embodiments, X is H or —$OR^1$, wherein $R'$ is optionally substituted $C_{1-6}$ alkyl. In some embodiments, X is H. In some embodiments, X is —OMe. In some embodiments, X is —$OCH_2CH_2OCH_3$. In some embodiments, X is —F.

In some embodiments, an example cycle is depicted in Scheme I-f.

Scheme I-e. Example cycle using DPSE chiral auxiliary.

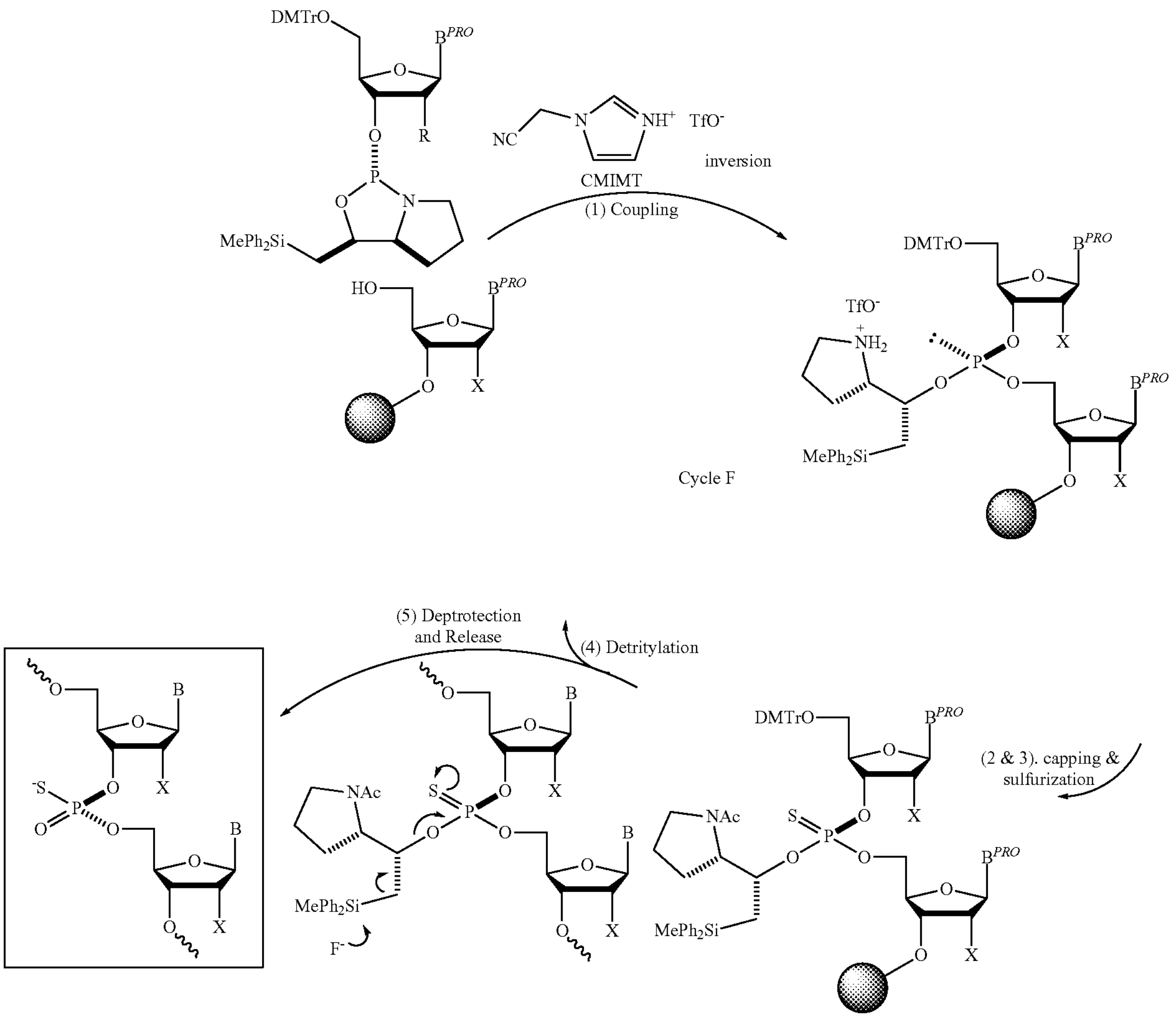

Stereodefined Phosphorothioate Oligonucleotide

In some embodiments, X is H or a 2'-modification. In some embodiments, X is H or —$OR^1$, wherein $R^1$ is not hydrogen. In some embodiments, X is H or —$OR^1$, wherein $R^1$ is optionally substituted $C_{1-6}$ alkyl. In some embodiments, X is H. In some embodiments, X is —OMe. In some embodiments, X is —$OCH_2CH_2OCH_3$. In some embodiments, X is —F.

It is understood by a person having ordinary skill in the art that different types of cycles may be combined to provide complete control of the chemical modifications and stereochemistry of oligonucleotides. In some embodiments, for example, an oligonucleotide synthesis process may contain one or more Cycles A-F. In some embodiments, a provided method comprises at least one cycle using a DPSE-type chiral auxiliary.

In some embodiments, the present disclosure provides methods for preparing provided oligonucleotide and oligonucleotide compositions. In some embodiments, a provide methods comprising providing a provided chiral reagent having the structure of

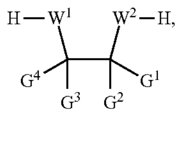

wherein $W^1$ is —$NG^5$, $W^2$ is O, each of $G^1$ and $G^3$ is independently hydrogen or an optionally substituted group selected from $C_{1-10}$ aliphatic, heterocyclyl, heteroaryl and aryl, $G^2$ is —$C(R)_2Si(R)_3$, and $G^4$ and $G^5$ are taken together to form an optionally substituted saturated, partially unsaturated or unsaturated heteroatom-containing ring of up to about 20 ring atoms which is monocyclic or polycyclic, fused or unfused, wherein each R is independently hydrogen, or an optionally substituted group selected from $C_1$-$C_6$ aliphatic, carbocyclyl, aryl, heteroaryl, and heterocyclyl. In some embodiments, a provided chiral reagent has the structure of

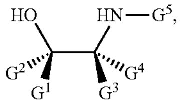, 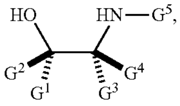, 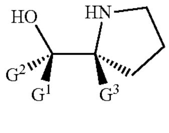, or 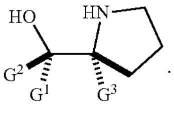.

In some embodiments, a provided methods comprises providing a phosphoramidite comprising a moiety from a chiral reagent having the structure of

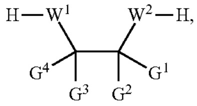, 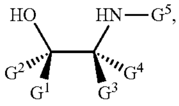, 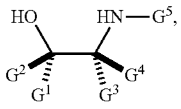, 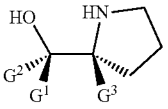, or 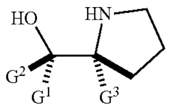, wherein —$W^1$H and —$W^2$H, or the hydroxyl and amino groups, form bonds with the phosphorus atom of the phosphoramidite. In some embodiments, —$W^1$H and —$W^2$H, or the hydroxyl and amino groups, form bonds with the phosphorus atom of the phosphoramidite, e.g., in

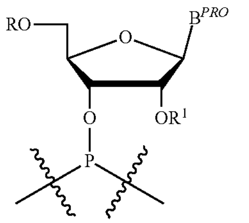 or 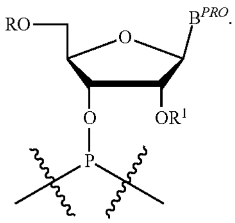.

In some embodiments, a phosphoramidite has the structure of

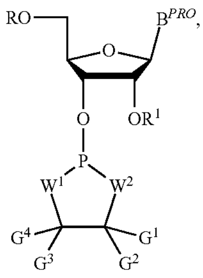, 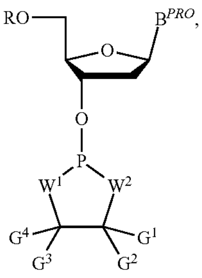,

-continued

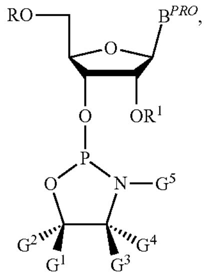, 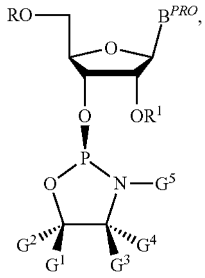,

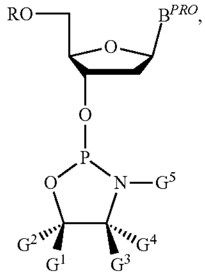, 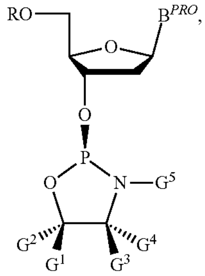,

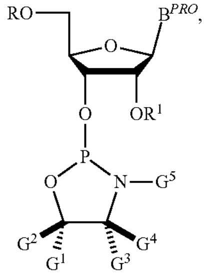, 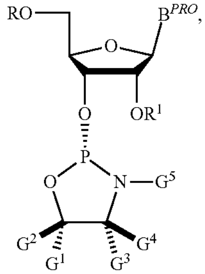,

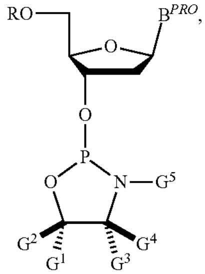, 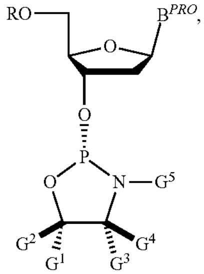,

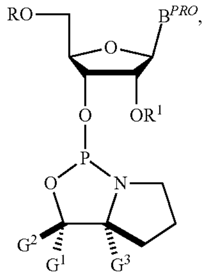, 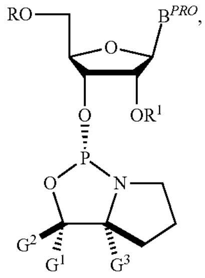,

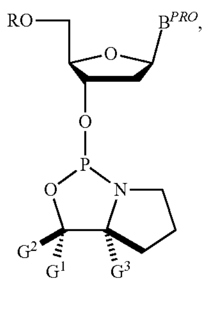, 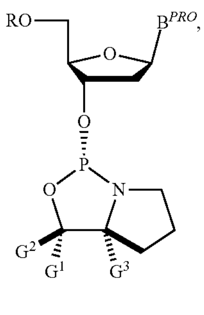,

-continued

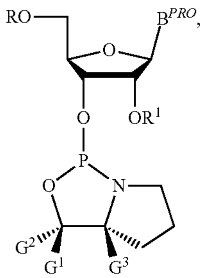

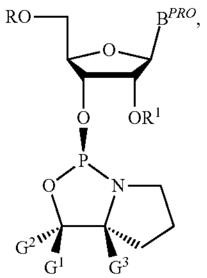

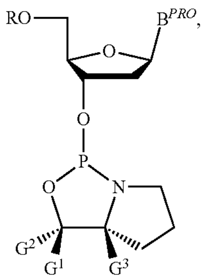

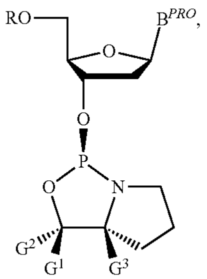

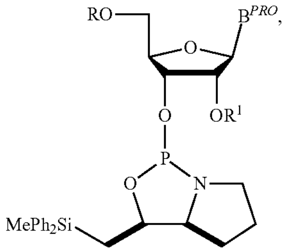

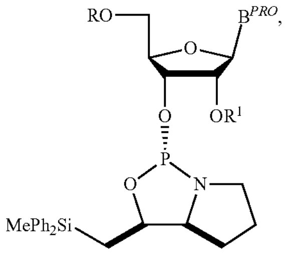

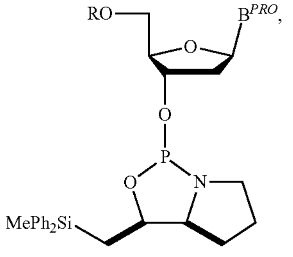

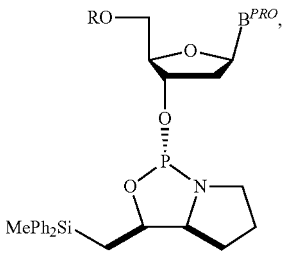

-continued

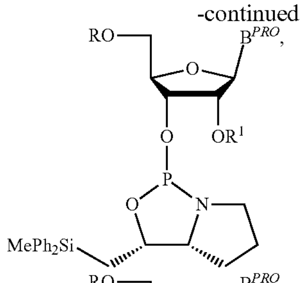

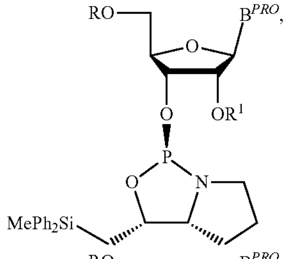

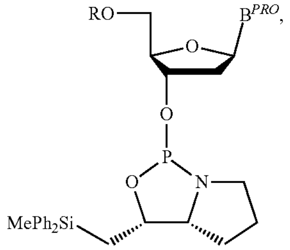

or

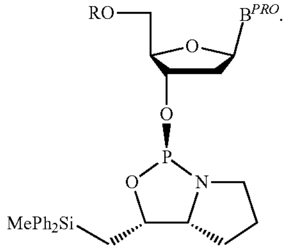

In some embodiments, R is a protection group. In some embodiments, R is DMTr. In some embodiments, $G^2$ is $—C(R)_2Si(R)_3$, wherein $—C(R)_2—$ is optionally substituted $—CH_2—$, and each R of $—Si(R)_3$ is independently an optionally substituted group selected from $C_{1-10}$ aliphatic, heterocyclyl, heteroaryl and aryl. In some embodiments, at least one R of $—Si(R)_3$ is independently optionally substituted $C_{1-10}$ alkyl. In some embodiments, at least one R of $—Si(R)_3$ is independently optionally substituted phenyl. In some embodiments, one R of $—Si(R)_3$ is independently optionally substituted phenyl, and each of the other two R is independently optionally substituted $C_{1-10}$ alkyl. In some embodiments, one R of $—Si(R)_3$ is independently optionally substituted $C_{1-10}$ alkyl, and each of the other two R is independently optionally substituted phenyl. In some embodiments, $G^2$ is optionally substituted $—CH_2Si(Ph)(Me)_2$. In some embodiments, $G^2$ is optionally substituted $—CH_2Si(Me)(Ph)_2$. In some embodiments, $G^2$ is $—CH_2Si(Me)(Ph)_2$. In some embodiments, $G^4$ and $G^5$ are taken together to form an optionally substituted saturated 5-6 membered ring containing one nitrogen atom (to which $G^5$ is attached). In some embodiments, $G^4$ and $G^5$ are taken together to form an optionally substituted saturated 5-membered ring containing one nitrogen atom. In some embodiments, $G^1$ is hydrogen. In some embodiments, $G^3$ is hydrogen. In some embodiments, both $G^1$ and $G^3$ are hydrogen. In some embodiments, both $G^1$ and $G^3$ are hydrogen, $G^2$ is —$C(R)_2Si(R)_3$, wherein —$C(R)_2$— is optionally substituted —$CH_2$—, and each R of —$Si(R)_3$ is independently an optionally substituted group selected from $C_{1-10}$ aliphatic, heterocyclyl, heteroaryl and aryl, and $G^4$ and $G^5$ are taken together to form an optionally substituted saturated 5-membered ring containing one nitrogen atom. In some embodiments, a provided method further comprises providing a fluoro-containing reagent. In some embodiments, a provided fluoro-containing reagent removes a chiral reagent, or a product formed from a chiral reagent, from oligonucleotides after synthesis. Various known fluoro-containing reagents, including those $F^-$ sources for removing —$SiR_3$ groups, can be utilized in accordance with the present disclosure, for example, TBAF, $HF_3$-$Et_3N$ etc. In some embodiments, a fluoro-containing reagent provides better results, for example, shorter treatment time, lower temperature, less de-sulfurization, etc, compared to traditional methods, such as concentrated ammonia. In some embodiments, for certain fluoro-containing reagent, the present disclosure provides linkers for improved results, for example, less cleavage of oligonucleotides from support during removal of chiral reagent (or product formed therefrom during oligonucleotide synthesis). In some embodiments, a provided linker is an SP linker. In some embodiments, the present disclosure demonstrated that a HF-base complex can be utilized, such as HF—$NR_3$, to control cleavage during removal of chiral reagent (or product formed therefrom during oligonucleotide synthesis). In some embodiments, HF—$NR_3$ is HF-$NEt_3$. In some embodiments, HIF—$NR_3$ enables use of traditional linkers, e.g., succinyl linker.

In some embodiments, the present disclosure comprises a method for manufacturing an oligonucleotide composition directed to a selected target sequence, the method comprising manufacturing a provided oligonucleotide composition comprising a first plurality of oligonucleotides, each of which has a base sequence complementary to the target sequence. In some embodiments, a provided method further comprises providing a pharmaceutically acceptable carrier.

As appreciated by a person having ordinary skill in the art, provided oligonucleotides can also be prepared through known solution phase synthesis using provided reagents and methods in accordance with the present disclosure.

Biological Applications and Example Use

As described herein, provided compositions and methods are capable of altering splicing of transcripts. In some embodiments, provided compositions and methods provide improved splicing patterns of transcripts compared to a reference pattern, which is a pattern from a reference condition selected from the group consisting of absence of the composition, presence of a reference composition, and combinations thereof. An improvement can be an improvement of any desired biological functions. In some embodiments, for example, in DMD, an improvement is production of an mRNA from which a dystrophin protein with improved biological activities is produced. In some other embodiments, for example, an improvement is down-regulation of STAT3, HNRNPH1 and/or KDR to mitigate tumor progression, malignancy, and angiogenesis through forced splicing-induced nonsense-mediated decay (DSD-NMD).

In some embodiments, the present disclosure provides a method for altering splicing of a target transcript, comprising administering a composition comprising a first plurality of oligonucleotides, wherein the splicing of the target transcript is altered relative to reference conditions selected from the group consisting of absence of the composition, presence of a reference composition, and combinations thereof.

In some embodiments, the present disclosure provides a method of generating a set of spliced products from a target transcript, the method comprising steps of:

contacting a splicing system containing the target transcript with an oligonucleotide composition comprising a first plurality of oligonucleotides, in an amount, for a time, and under conditions sufficient for a set of spliced products to be generated that is different from a set generated under reference conditions selected from the group consisting of absence of the composition, presence of a reference composition, and combinations thereof.

As widely known in the art, many diseases and/or conditions are associated with transcript splicing. For examples, see Garcia-Blanco, et al., Alternative splicing in disease and therapy, *Nat Biotechnol.* 2004 May; 22(5):535-46; Wang, et al., Splicing in disease: disruption of the splicing code and the decoding machinery, *Nat Rev Genet.* 2007 October; 8(10):749-61; Havens, et al., Targeting RNA splicing for disease therapy, *Wiley Interdiscip Rev RNA.* 2013 May-June; 4(3):247-66; Perez, et al., Antisense mediated splicing modulation for inherited metabolic diseases: challenges for delivery, Nucleic Acid Ther. 2014 February; 24(1):48-56; etc. Additional example targets and/or disease are described in Xiong, et al., The human splicing code reveals new insights into the genetic determinants of disease, *Science.* 2015 Jan. 9; 347(6218):1254806. doi: 10.1126/science.1254806. In some embodiments, the present disclosure provides compositions and methods for treating or preventing diseases, including but not limited to those described in references cited in this disclosure.

In some embodiments, the present disclosure provides a method for treating or preventing a disease, comprising administering to a subject an oligonucleotide composition described herein.

In some embodiments, the present disclosure provides a method for treating or preventing a disease, comprising administering to a subject an oligonucleotide composition comprising a first plurality of oligonucleotides, which:

1) have a common base sequence complementary to a target sequence in a transcript; and
2) comprise one or more modified sugar moieties and modified internucleotidic linkages, the oligonucleotide composition being characterized in that, when it is contacted with the transcript in a transcript splicing system, splicing of the transcript is altered relative to that observed under reference conditions selected from the group consisting of absence of the composition, presence of a reference composition, and combinations thereof.

In some embodiments, the present disclosure provides a method for treating or preventing a disease, comprising administering to a subject an oligonucleotide composition comprising a first plurality of oligonucleotides of a particular oligonucleotide type defined by:

1) base sequence;
2) pattern of backbone linkages;
3) pattern of backbone chiral centers; and
4) pattern of backbone phosphorus modifications, which composition is chirally controlled in that it is enriched, relative to a substantially racemic preparation of oligonucleotides having the same base sequence, for oligonucleotides of the particular oligonucleotide type, wherein:

the oligonucleotide composition being characterized in that, when it is contacted with the transcript in a transcript splicing system, splicing of the transcript is altered relative to that observed under reference conditions selected from the group consisting of absence of the composition, presence of a reference composition, and combinations thereof.

In some embodiments, a disease is one in which, after administering a provided composition, one or more spliced transcripts repair, restore or introduce a new beneficial function. For example, in DMD, after skipping one or more exons, functions of dystrophin can be restored, or partially restored, through a truncated but (partially) active version. Other examples include but are not limited to those listed in Table ES1, ES2, or ES3. In some embodiments, a target is one listed in Table ES3 with "Correction of Aberrant Splicing".

In some embodiments, a disease is one in which, after administering a provided composition, one or more spliced transcripts repair, a gene is effectively knockdown by altering splicing of the gene transcript. Examples include but are not limited to those listed in Table ES1, ES2, or ES3. In some embodiments, a target is one listed in Table ES3 with "Knockdown of Detrimental Gene Expression".

In some embodiments, a disease is Duchenne muscular dystrophy. In some embodiments, a disease is spinal muscular atrophy. In some embodiments, a disease is cancer.

In some embodiments, the present disclosure provides a method of treating a disease by administering a composition comprising a first plurality of oligonucleotides sharing a common base sequence comprising a common base sequence, which nucleotide sequence is complementary to a target sequence in the target transcript, the improvement that comprises using as the oligonucleotide composition a stereocontrolled oligonucleotide composition characterized in that, when it is contacted with the transcript in a transcript splicing system, splicing of the transcript is altered relative to that observed under reference conditions selected from the group consisting of absence of the composition, presence of a reference composition, and combinations thereof.

In some embodiments, the present disclosure provides a method of treating a disease by administering a composition comprising a first plurality of oligonucleotides sharing a common base sequence comprising a common base sequence, which nucleotide sequence is complementary to a target sequence in the target transcript, the improvement that comprises using as the oligonucleotide composition a stereocontrolled oligonucleotide composition characterized in that, when it is contacted with the transcript in a transcript splicing system, splicing of the transcript is altered relative to that observed under reference conditions selected from the group consisting of absence of the composition, presence of a reference composition, and combinations thereof.

In some embodiments, a common sequence of a plurality of oligonucleotides comprises a sequence selected from Table ES1. In some embodiments, a common sequence is a sequence selected from Table ES1. In some embodiments, a common sequence is a sequence found is a transcript of any of the genes selected from Table ES1, ES2, and ES3.

Example diseases that can be treated include but are not limited to those described in Tables ES2 and ES3. In some embodiments, a disease is Duchenne muscular dystrophy. In some embodiments, a disease is spinal muscular atrophy. In some embodiments, a disease is cancer.

For Duchenne muscular dystrophy, example mutations and/or suitable DMD exons for skipping are widely known in the art, including but not limited to those described in U.S. Pat. Nos. 8,759,507, 8,486,907, and reference cited therein.

In some embodiments, one or more skipped exons are selected from exon 2, 29, 40, 41, 42, 43, 44, 45, 46, 47, 48, 49, 50, 51 and 53. In some embodiments, exon 2 of DMD is skipped. In some embodiments, exon 29 of DMD is skipped. In some embodiments, exon 40 of DMD is skipped. In some embodiments, exon 41 of DMD is skipped. In some embodiments, exon 42 of DMD is skipped. In some embodiments, exon 43 of DMD is skipped. In some embodiments, exon 44 of DMD is skipped. In some embodiments, exon 45 of DMD is skipped. In some embodiments, exon 46 of DMD is skipped. In some embodiments, exon 47 of DMD is skipped. In some embodiments, exon 48 of DMD is skipped. In some embodiments, exon 49 of DMD is skipped. In some embodiments, exon 50 of DMD is skipped. In some embodiments, exon 51 of DMD is skipped. In some embodiments, exon 53 of DMD is skipped. In some embodiments, a skipped exon is any exon whose inclusion decreases a desired function of DMD. In some embodiments, a skipped exon is any exon whose skipping increased a desired function of DMD.

In some embodiments, for exon skipping of DMD transcript, or for treatment of DMD, a sequence of a provided plurality of oligonucleotides comprises a DMD sequence selected from Table ES1. In some embodiments, a sequence comprises one of SEQ ID Nos 1-30 of U.S. Pat. No. 8,759,507. In some embodiments, a sequence comprises one of SEQ ID Nos 1-211 of U.S. Pat. No. 8,486,907. In some embodiments, for exon skipping of DMD transcript, or for treatment of DMD, a sequence of a provided plurality of oligonucleotides is a DMD sequence selected from Table ES1. In some embodiments, a sequence is one of SEQ ID Nos 1-30 of U.S. Pat. No. 8,759,507. In some embodiments, a sequence is one of SEQ ID Nos 1-211 of U.S. Pat. No. 8,486,907. In some embodiments, a sequence comprises UCAAGGAAGAUGGCAUUUCU (SEQ ID NO: 54). In some embodiments, a sequence is UCAAGGAAGAUGGCAUUUCU (SEQ ID NO: 54). In some embodiments, a sequence comprises CTCCAACATCAAGGAAGATGGCATTTCTAG (SEQ ID NO: 870). In some embodiments, a sequence is CTCCAACATCAAGGAAGATGGCATTTCTAG (SEQ ID NO: 870). In some embodiments, a sequence is selected from Table 2B. In some embodiments, a sequence is selected from Table 2C. In some embodiments, a sequence is selected from Table 2D. In some embodiments, a sequence is selected from Table 2E. In some embodiments, a sequence is one described in Kemaladewi, et al., Dual exon skipping in myostatin and dystrophin for Duchenne muscular dystrophy, BMC Med Genomics. 2011 Apr. 20; 4:36. doi: 10.1186/1755-8794-4-36; or Malerba et al., Dual Myostatin and Dystrophin Exon Skipping by Morpholino Nucleic Acid Oligomers Conjugated to a Cell-penetrating Peptide Is a Promising Therapeutic Strategy for the Treatment of Duchenne Muscular Dystrophy, Mol Ther Nucleic Acids. 2012 Dec. 18; 1:e62. doi: 10.1038/mtna.2012.54.

In some embodiments, a disease treatment comprises knockdown of a gene function by altering its transcript splicing. Example disease and target genes include but are not limited to those listed in Table ES3, particularly those with labeled with "Knockdown of Detrimental Gene Expression".

TABLE ES1

Example sequences.

| | |
|---|---|
| cccauuuugugaauguuuucuuuu | TAGATAGCTATATAT |
| uuguguauuuacccauuuugug | ATAGATAGCTATATA |
| Uauccucugaaugucgcauc | TATAGATAGCTATAT |
| gguuauccucugaaugucgc | ATATAGATAGCTATA |
| Gagccuuuuuucuucuuug | GATATAGATAGCTAT |
| Uccuuucgucucugggcuc | ATAGATAGCTAT |
| Cuccucuuucuucuucugc | AGATATAGATAGCTA |
| Cuucgaaacugagcaaauuu | TATAGATAGCTA |
| cuugugagacaugagug | TAGATATAGATAGCT |
| cagagacuccucuugcuu | ATATAGATAGCT |
| ugcugcugucuucuugcu | ATAGATATAGATAGC |
| Uuguuaacuuuuucccauu | GATATAGATAGC |
| cgccgccauuucucaacag | TATAGATATAGATAG |
| | AGATATAGATAG |
| | ATATAGATATAGATA |
| | TAGATATAGATA |
| | TATATAGATATAGAT |
| | ATAGATATAGAT |

(Left: SEQ ID NOS 871-883, respectively in order of appearance; right: SEQ ID NOS 884-901, respectively in order of appearance)

| | |
|---|---|
| TATAGATATAGA | TTTTGATTTTGTCTA |
| ATATAGATATAG | TGATTTTGTCTA |
| ATAGCTATATAGATA | TTGATTTTGTCT |
| AAAAAATAGCTATAT | TTTTTGATTTTGTCT |
| GTTAAAAAAAATAGC | TTTGATTTTGTC |
| AGGAAGTTAAAAAAA | CTTTTTGATTTTGTC |
| AATAAAGGAAGTTAA | TTTTGATTTTGT |
| AGGAAAATAAAGGAA | TTTTTGATTTTG |
| GTGTAAGGAAAATAA | CTTCTTTTTGATTTT |
| ATTTTGTCTAAAACC | CTTTTTGATTTT |
| GATTTTGTCTAAAAC | TCTTTTTGATTT |
| TTTTGTCTAAAA | CCTTCCTTCTTTTTG |
| TGATTTTGTCTAAAA | GAGCACCTTCCTTCT |
| ATTTTGTCTAAA | AATGTGAGCACCTTC |
| TTGATTTTGTCTAAA | TAAGGAATGTGAGCA |
| GATTTTGTCTAA | AATTTAAGGAATGTGAGC |
| TTTGATTTTGTCTAA | TTAAGGAATGTGAGC |
| TTTTGATTTTGTCTAA | TAATTTAAGGAATGTGAG |
| | TTTAAGGAATGTGAG |

(Left: SEQ ID NOS 902-919, respectively in order of appearance; right: SEQ ID NOS 920-938, respectively in order of appearance)

| | |
|---|---|
| AAGGAATGTGAG | TTAATTTAAGGA |
| TTAATTTAAGGAATGTGA | CTTAATTTAAGG |
| ATTTAAGGAATGTGA | CCTTAATTTAAG |
| TAAGGAATGTGA | TGCTGGCAGACTTAC |
| CTTAATTTAAGGAATGTG | CATAATGCTGGCAGA |
| AATTTAAGGAATGTG | TCATAATGCTGGCAG |
| TTAAGGAATGTG | TTCATAATGCTGGCA |
| TAATTTAAGGAATGT | TTTCATAATGCTGGC |
| CCTTAATTTAAGGAATGT | ATTCACTTTCATAATGCTGG |
| TTTAAGGAATGT | CTTTCATAATGCTGG |
| TTAATTTAAGGAATG | TCATAATGCTGG |
| ATTTAAGGAATG | ACTTTCATAATGCTG |
| CTTAATTTAAGGAAT | TTCATAATGCTG |
| AATTTAAGGAAT | CACTTTCATAATGCT |
| CCTTAATTTAAGGAA | TTTCATAATGCT |
| TAATTTAAGGAA | TCACTTTCATAATGC |
| TCCTTAATTTAAGGA | GTTTCATAATGC |
| | TTCACTTTCATAATG |
| | ACTTTCATAATG |
| | ATTCACTTTCATAAT |

(Left: SEQ ID NOS 939-955, respectively in order of appearance; right: SEQ ID NOS 956-975, respectively in order of appearance)

| | |
|---|---|
| CACTTTCATAAT | ATT CAC TTT CAT AAT GCT GG |
| GATTCACTTTCATAA | ATT CAC TTT CAT AAT GCT GG |
| TCACTTTCATAA | ATT CAC TTT CAT AAT GCT GG |
| TTCACTTTCATA | ATT CAC TTT CAT AAT GCT GG |
| ATTCACTTTCAT | ATT CAC TTT CAT AAT GCT GG |
| AGTAAGATTCACTTT | ATT CAC TTT CAT AAT GCT GG |
| ACAAAAGTAAGATTC | ATT CAC TTT CAT AAT GCT GG |
| GTTTTACAAAAGTAA | ATT CAC TTT CAT AAT GCT GG |
| ATAAAGTTTTACAAA | CAC TTT CAT AAT GCT GG |
| AAACCATAAAGTTTT | CAC TTT CAT AAT GCT GG |
| TCCACAAACCATAAA | CAC TTT CAT AAT GCT GG |
| | CAC TTT CAT AAT GCT GG |

TABLE ES1-continued

| Example sequences. | |
|---|---|
| | CAC TTT CAT AAT GCT GG |
| | CAC TTT CAT AAT GCT GG |
| | CAC TTT CAT AAT GCT GG |
| | CAC TTT CAT AAT GCT GG |
| | CAC TTT CAT AAT GCT GG |
| | CAC TTT CAT AAT GCT GG |
| | TTT CAT AAT GCT GG |
| | TTT CAT AAT GCT GG |
| | TTT CAT AAT GCT GG |
| | TTT CAT AAT GCT GG |
| | TTT CAT AAT GCT GG |
| | TTT CAT AAT GCT GG |
| | TTT CAT AAT GCT GG |
| (Left: SEQ ID NOS 976-986, respectively in order of appearance; right: SEQ ID NOS 987-1011, respectively in order of appearance) | |
| AAT GCT GGC AG | C CAG CAT TTC CTG CAA ATG AG |
| AAT GCT GGC AG | C CAG CAT TTC CTG CAA ATG AG |
| AAT GCT GGC AG | C CAG CAT TTC CTG CAA ATG AG |
| AAT GCT GGC AG | C CAG CAT TTC CTG CAA ATG AG |
| AAT GCT GGC AG | C CAG CAT TTC CTG CAA ATG AG |
| AAT GCT GGC AG | C CAG CAT TTC CTG CAA ATG AG |
| AAT GCT GGC AG | C CAG CAT TTC CTG CAA ATG AG |
| GCT GGC AG | C CAG CAT TTC CTG CAA ATG AG |
| GCT GGC AG | C CAG CAT TTC CTG CAA ATG AG |
| GCT GGC AG | A TGC CAG CAT TTC CTG CAA ATG AGA |
| GCT GGC AG | A TGC CAG CAT TTC CTG CAA ATG AGA |
| GCT GGC AG | A TGC CAG CAT TTC CTG CAA ATG AGA |
| GCT GGC AG | A TGC CAG CAT TTC CTG CAA ATG AGA |
| GCT GGC AG | A TGC CAG CAT TTC CTG CAA ATG AGA |
| GCT GGC AG | A TGC CAG CAT TTC CTG CAA ATG AGA |
| GCT GGC AG | A TGC CAG CAT TTC CTG CAA ATG AGA |
| C TAG TAT TTC CTG CAA ATG AG | A TGC CAG CAT TTC CTG CAA ATG AGA |
| C TAG TAT TTC CTG CAA ATG AG | GCT CTA TGC CAG CAT TTC CTG CAA A |
| C TAG TAT TTC CTG CAA ATG AG | GCT CTA TGC CAG CAT TTC CTG CAA A |
| C TAG TAT TTC CTG CAA ATG AG | GCT CTA TGC CAG CAT TTC CTG CAA A |
| C TAG TAT TTC CTG CAA ATG AG | GCT CTA TGC CAG CAT TTC CTG CAA A |
| C TAG TAT TTC CTG CAA ATG AG | GCT CTA TGC CAG CAT TTC CTG CAA A |
| C TAG TAT TTC CTG CAA ATG AG | GCT CTA TGC CAG CAT TTC CTG CAA A |
| C TAG TAT TTC CTG CAA ATG AG | GCT CTA TGC CAG CAT TTC CTG CAA A |
| C TAG TAT TTC CTG CAA ATG AG | GCT CTA TGC CAG CAT TTC CTG CAA A |
| C TAG TAT TTC CTG CAA ATG AG | GCT CTA TGC CAG CAT TTC CTG CAA A |
| C TAG TAT TTC CTG CAA ATG AG | GCT CTA TGC CAG CAT TTC CTG CAA A |
| (Left: SEQ ID NOS 1012-1038, respectively in order of appearance; right: SEQ ID NOS 1039-1065, respectively in order of appearance) | |
| SEQ ID Nos 1-30 of U.S. Pat. No. 8,759,507; | |
| SEQ ID Nos 1-211 of U.S. Pat. No. U.S. Pat. No. 8,486,907; | |

TABLE ES2

| Disease | Sequence | Location | Parent of origin of expansion | Repeat number (normal) | Repeat number (pre-mutation) | Repeat number (disease) | Somatic instability |
|---|---|---|---|---|---|---|---|
| Diseases with coding TNRs | | | | | | | |
| DRPLA | CAG | ATN1 (exon 5) | P | 6-35 | 35-48 | 49-88 | Yes |
| HD | CAG | HTT (exon 1) | P | 6-29 | 29-37 | 38-180 | Yes |
| OPMD | GCN | PABPN1 (exon 1) | P and M | 10 | 12-17 | >11 | None found in tissue tested (hypothalamus) |
| SCA1 | CAG | ATXN1 (exon 8) | P | 6-39 | 40 | 41-83 | Yes |
| SCA2 | CAG | ATXN2 (exon 1) | P | <31 | 31-32 | 32-200 | Unknown |
| SCA3 (Machado-Joseph disease) | CAG | ATXN3 (exon 8) | P | 12-40 | 41-85 | 52-86 | Unknown |
| SCA6 | CAG | CACNA1A (exon 47) | P | <18 | 19 | 20-33 | None found |
| SCA7 | CAG | ATXN7 (exon 3) | P | 4-17 | 28-33 | >36 to >460 | Yes |
| SCA17 | CAG | TBP (exon 3) | P > M | 25-42 | 43-48 | 45-66 | Yes |
| SMBA | CAG | AR (exon 1) | P | 13-31 | 32-39 | 40 | None found |

TABLE ES2-continued

| Disease | Sequence | Location | Parent of origin of expansion | Repeat number (normal) | Repeat number (pre-mutation) | Repeat number (disease) | Somatic instability |
|---|---|---|---|---|---|---|---|
| Diseases with non-coding TNRs | | | | | | | |
| DM1 | CTG | DMPK (3' UTR) | M | 5-37 | 37-50 | <50 | Yes |
| DM2 | CCTG | CNBP (intron 1) | Uncertain | <30 | 31-74 | 75-11,000 | Yes |
| FRAX-E | GCC | AFF2 (5' UTR) | M | 4-39 | 40-200 | >200 | Unknown |
| FRDA | GAA | FXN (intron 1) | Recessive | 5-30 | 31-100 | 70-1,000 | Yes |
| FXS | CGG | FMR1 (5' UTR) | M | 6-50 | 55-200 | 200-4,000 | Yes |
| HDL2 | CTG | JPH3 (exon 2A) | M | 6-27 | 29-35 | 36-57 | Unknown |
| SCA8 | CTG | ATXN8OS (3' UTR) | M | 15-34 | 34-89 | 89-250 | Unknown |
| SCA10 | ATTCT | ATXN10 (intron 9) | M and P (smaller changes with M) | 10-29 | 29-400 | 400-4,500 | Yes |
| SCA12 | CAG | PPP2R2B (5' UTR) | M and P (more unstable with P) | 7-28 | 28-66 | 66-78 | None found |

AFF2, AF4/FMR2 family, member 2; AR, androgen receptor; ATN1, atrophin 1; ATXN, ataxin; ATXN8OS, ATXN8 opposite strand (non-protein coding); CACNA1A, calcium channel, voltage-dependent, P/Q type, alpha 1A subunit; CNBP, CCHC-type zinc finger nucleic acid binding protein; DM, myotonic dystrophy; DMPK, dystrophia myotonica-protein kinase; DRPLA, dentatorubral-pallidoluysian atrophy; FMR1, fragile X mental retardation 1; FRAX-E, mental retardation, X-linked, associated with FRAXE; FRDA, Friedreich's ataxia; FXN, frataxin; FXS, fragile X syndrome; FXTAS, fragile X-associated tremor/ataxia syndrome; HD, Huntington's disease; HDL2, Huntington's disease-like 2; HTT, huntingtin; JPH3, junctophilin 3; M, maternal; OPMD, oculopharyngeal muscular dystrophy; P, paternal; PABPN1, poly(A) binding protein nuclear 1; PPP2R2B, protein phosphatase 2, regulatory subunit B; SCA, spinocerebellar ataxia; SMBA, spinomuscular bulbar atrophy; TBP, TATA-box binding protein; TNR, trinucleotide repeat.

TABLE ES3

| | | | |
|---|---|---|---|
| | | Ataxia telangiectasia | ATM |
| | | β-Thalassemia | HBB |
| | | Cancer | BRCA2 |
| | | CDG1A[2] | PMM2 |
| | | Congenital adrenal insufficiency | CYP11A |
| | | Cystic fibrosis | CFTR |
| Bardet-Biedl syndrome | BBS1 | Duchenne muscular dystrophy | DMD |
| β-Thalassemia | HBB | Fukuyama congenital muscular dystrophy (FCMD) | FKTN |
| Cancer | BRCA1 | Growth hormone insensitivity | GHR |
| | PTCH1 | HPABH4A[2] | PTS |
| Cystic fibrosis | CFTR | Hutchinson-Gillford progeria (HGPS) | LMNA |
| Duchenne muscular dystrophy | DMD | MLC1[2] | MLC1 |
| Factor VII deficiency | F7 | Methylmalonic aciduria | MUT |
| Familial dysautonomia | IKBKAP | Myopathy with lactic acidosis | ISCU |
| Fanconi anemia | FANCC | Myotonic dystrophy | CLC1 |
| Hemophilia A | F9 | Neurofibromatosis | NF1 |
| Propionic acidemia | PCCA | Niemann-Pick type C | NPC1 |
| Retinitis pigmentosa | RHO | Propionic acidemia | PCCB |
| | RPGR | Usher syndrome | USH1C |
| | | Alzheimer's disease/FTDP-17 Taupathies | MAPT |
| | | Cancer | BCL2L1 |
| | | | FGFR1 |
| | | | MCL1 |
| | | | MDM2 |
| Afibrinogenemia | FGB | | Multiple |
| Cancer | BRCA1 | | PKM |
| Propionic acidemia | PCCA | | MST1R |
| Neurofibromatosis | NF1 | | USP5 |
| Ocular albinism type 1 | GRP143 | Spinal muscular atrophy | SMN2 |
| Alzheimer's disease | BACE1 | | |
| Cancer | CDKN1A | | |
| | ERBB2 | | |
| | FLT1 | | |
| | HNRNPH1 | | |
| | KDR | | |
| | MYC | | |
| | Multiple | | |
| | PHB | | |
| | SRA1 | | |
| | STAT3 | | |
| | TERT | | |
| | WT1 | Duchenne muscular dystrophy | DMD |

TABLE ES3-continued

| | | | | |
|---|---|---|---|---|
| FHBL/atherosclerosis[2] | APOB | | | |
| Immune-response | CD40 | | | |
| Inflammatory disease | TNFRSF1B<br>IL5RA | | | |
| Influenza virus | TMPRSS2 | Dystrophic epidermolysis bullosa | | COL7A1 |
| Muscle wasting diseases | MSTN | | | |
| Spinocerebellar ataxia type 1 | ATXN1 | Miyoshi myopathy | | DYSF |

| Gene | Effect | Disease | Variant location | Effect on splicing/protein |
|---|---|---|---|---|
| | | Modifies disease phenotype | | |
| CFTR | cis | Cystic fibrosis | (TG)n and Tn polymorphisms in CFTR intron 8 | Affects the amount of exon 9 skipping |
| MCAD | cis | Medium-chain acyl-CoA dehydrogenase deficiency | ESS within exon 5 | Prevents effect of disease-causing ESE mutation |
| SCN1A | cis | Susceptibility to anti-epileptics | 5' splice site of neonatal alternative exon | Increased use of neonatal alternative exon |
| CFTR | cis and trans | Cystic fibrosis | Point mutation in intron 19 creates a variably spliced 84-nucleotide exon | Variable level of cryptic exon inclusion influences severity |
| IKBKAP | trans | Familial dysautonomia | n/a | Tissue-specific differences in recognition of mutant 5' splice site |
| Scn8a | cis and trans | Neurological disorder (mouse) | 4-bp deletion within the 5'-splice site of exon 3 | 5' splice-site mutation modified by Scnm1 |
| | | Linked with disease susceptibility | | |
| IRF5 | cis | Systemic lupus erythematosus (SLE) | One SNP between alternative promoters creates 5' splice site | SNP creates 5' splice site and new first exon |
| CTLA4 | cis | Autoimmune diseases | Two SNPs in 3' UTR (exon 4) | Increased exon 3 skipping; reduced soluble isoform |
| NCAM1 | cis | Bipolar disorder | Two SNPs, one within cluster of alternative exons | Decreased expression of secreted splice variants |
| ERBB4 | cis | Schizophrenia | One SNP in intron 12 and SNPs near exon 3 linked with splicing of exons 16 and 26, respectively | Increased use of exons 16 and 26 |
| OLR1 | cis | Myocardial infarction | Six SNPs; three in intron 4, two in intron 5, one in the 3' UTR in exon 6 | Exon 5 skipping results in an isoform with reduced apoptotic effects |
| OAS1 | cis | TypeI diabetes | Intron 6 AG→AA variant shifts 3' splice site by 1 nucleotide, changing the reading frame | SNP moves splice site by 1 nucleotide resulting in a longer protein |
| TNNT2 | cis | Cardiac hypertrophy | 5-bp deletion affects intron 3 splice site | Results in E4 skipping (minigene analysis) |
| GPRA | cis | Asthma | Three SNPs distal to alternative site | Increased use of the more distal of two terminal exons |
| MAPT | cis | Tauopathies | 238-bp insertion into intron 9 | Enhanced exon 10 inclusion |
| PTPRC (CD45) | cis | Altered immune function | A138G polymorphism axon 6 | Enhanced axon 6 skipping |
| PTPRC (CD45) | cis | Multiple sclerosis | C77G polymorphism axon 4 | Enhanced exon 4 inclusion |
| LDLR | cis | Elevated cholesterol | C688T polymorphism exon 12 | Enhanced exon 12 skipping |
| SFRS8 | trans | Asthma | n/a | None reported |

| Splicing factor[a] | OMIM number[b] | Disease association[c] |
|---|---|---|
| CUG triplet repeat, RNA-binding protein 1; CUGBP1 (CUGBP; NAB50; BRUNOL2) | 601074 | Myotonic dystrophy (DM) |
| CUG triplet repeat, RNA-binding protein 2; CUGBP2 (ETR3) | 602538 | Myotonic dystrophy (DM) |
| FUS-interacting protein I; FUSIP1 (TASR(1 or 2); SRp38; SRRp40; NSSR) | 605221 | Leukemias and sarcomas |
| Fusion, derived from 12-16 translocation, malignant liposarcoma; FUS (TLS) | 137070 | Liposarcomas, acute myeloid leukemia (AML) |
| Glycogen synthase kinase 3-BETA; GSK3B (GSK-3β) | 605004 | Alzheimer disease (AD) |
| Hydroxymethylglutaryl coenzyme A1a (HMGA1a) (HMG-I) | 600701 | Alzheimer disease (AD) |
| Muscleblind-like protein 1; MBNL1 (MBNL) | 606516 | Myotonic dystrophy (DM) |
| Muscleblind-like protein 2; MBNL2 (MBLL) | 607327 | Myotonic dystrophy (DM) |
| Muscleblind-like protein 3; MBNL3 (MBXL) | 300413 | Myotonic dystrophy (DM) |
| Neurooncologic ventral antigen 1; NOVA1 (Ri Ag) | 602157 | Paraneoplastic syndrome |
| Precursor mRNA-processing factor 3, Saccharomyces cereyisiae, homolog of PRPF3 (PRP3; HPRP3) | 607301 | Retinitis pigmentosa |

TABLE ES3-continued

| | | | |
|---|---|---|---|
| Precursor mRNA-processing factor 31, S. cereyisiae, homolog of PRPF31 (PRP31) | | 606419 | Retinitis pigmentosa |
| Precursor mRNA-processing factor 8, S. cereyisiae, homolog of PRPF8 (PRP8 PRPC8 U5 snRNP-specific protein, 220-K; p220) | | 607300 | Retinitis pigmentosa |
| RNA-binding motif protein, Y chromosome family 1, member A1; RBMY1A1 (RBMY; RBM1; RBM2; YRRM1; YRRM2) | | 400006 | Azospermia |
| Splicing factor HCC1 (HCC1.3; HCC1.4) | | 604739 | Hepatocellular carcinoma |
| Splicing factor, proline-and glutamine-rich SFPQ (PSF) | | 605199 | Papillary renal cell carcinoma |
| Survival of motor neuron 1, telomeric: SMN1 (SMN; SMNT; T-BCD541) | | 600354 | Spinal muscular atrophy |
| Survival of motor neuron 2, centromeric, SMN2 (SMNC; C-BCD541) | | 601627 | Spinal muscular atrophy |
| Tumor protein p73-like: TP73L p(63) | | 603273 | Hay-Wells syndrome |

| Disease | Human Target Gene | Gene Defects | Therapeutic modality | Approaches |
|---|---|---|---|---|
| Cancer | BRCA1 | Splice Site Mutations | ASO | Correction of Aberrant Splicing |
| Cancer | PTCH1 | Splice Site Mutations | ASO | Correction of Aberrant Splicing |
| Duchenne muscular dystrophy | DMD | Splice Site Mutations | ASO | Correction of Aberrant Splicing |
| Ataxia telangiectasia | ATM | Cryptic Splice Sites | ASO | Correction of Aberrant Splicing |
| Beta-thalassemia | HBB | Cryptic Splice Sites | ASO | Correction of Aberrant Splicing |
| Cancer | BRCA2 | Cryptic Splice Sites | ASO | Correction of Aberrant Splicing |
| CDG1A | PMM2 | Cryptic Splice Sites | ASO | Correction of Aberrant Splicing |
| Congenital adrenal insufficiency | CYP11A | Cryptic Splice Sites | ASO | Correction of Aberrant Splicing |
| Cystic fibrosis | CFTR | Cryptic Splice Sites | ASO | Correction of Aberrant Splicing |
| Duchenne muscular dystrophy | DMD | Cryptic Splice Sites | ASO | Correction of Aberrant Splicing |
| Fukuyama congenital muscular dystrophy (FCMD) | FKTN | Cryptic Splice Sites | ASO | Correction of Aberrant Splicing |
| Growth hormone insensitivity | GHR | Cryptic Splice Sites | ASO | Correction of Aberrant Splicing |
| HPABH4A | PTS | Cryptic Splice Sites | ASO | Correction of Aberrant Splicing |
| Hutchinson-Gilford progeria (HGPS) | LMNA | Cryptic Splice Sites | ASO | Correction of Aberrant Splicing |
| MLC1 | MLC1 | Cryptic Splice Sites | ASO | Correction of Aberrant Splicing |
| Methylmalonic aciduria | MUT | Cryptic Splice Sites | ASO | Correction of Aberrant Splicing |
| Myopathy with lactic acidosis | ISCU | Cryptic Splice Sites | ASO | Correction of Aberrant Splicing |
| Myotonic dystrophy | CLC1 | Cryptic Splice Sites | ASO | Correction of Aberrant Splicing |
| Neurofibromatosis | NF1 | Cryptic Splice Sites | ASO | Correction of Aberrant Splicing |

TABLE ES3-continued

| | | | | |
|---|---|---|---|---|
| Niemann-Pick type C | NPC1 | Cryptic Splice Sites | ASO | Correction of Aberrant Splicing |
| Propionic acidemia | PCCB | Cryptic Splice Sites | ASO | Correction of Aberrant Splicing |
| Usher syndrome | USH1C | Cryptic Splice Sites | ASO | Correction of Aberrant Splicing |
| Afibrinogenemia | FGB | Regulatory Sequence Mutations | ASO | Correction of Aberrant Splicing |
| Cancer | BRCA1 | Regulatory Sequence Mutations | ASO | Correction of Aberrant Splicing |
| Propionic acidemia | PCCA | Regulatory Sequence Mutations | ASO | Correction of Aberrant Splicing |
| Ocular albinism type 1 | GRP143 | Regulatory Sequence Mutations | ASO | Correction of Aberrant Splicing |
| Alzheimer's disease/FTDP-17 Taupathies | MAPT | Deregulated Alternative Splicing | ASO | Correction of Aberrant Splicing |
| Cancer | BCL2L1 | Deregulated Alternative Splicing | ASO | Correction of Aberrant Splicing |
| Cancer | FGFR1 | Deregulated Alternative Splicing | ASO | Correction of Aberrant Splicing |
| Cancer | MCL1 | Deregulated Alternative Splicing | ASO | Correction of Aberrant Splicing |
| Cancer | MDM2 | Deregulated Alternative Splicing | ASO | Correction of Aberrant Splicing |
| Cancer | PKM | Deregulated Alternative Splicing | ASO | Correction of Aberrant Splicing |
| Cancer | MST1R | Deregulated Alternative Splicing | ASO | Correction of Aberrant Splicing |
| Cancer | USP5 | Deregulated Alternative Splicing | ASO | Correction of Aberrant Splicing |
| Spinal muscular atrophy | SMN2 | Deregulated Alternative Splicing | ASO | Correction of Aberrant Splicing |
| Alzheimer's disease | BACE1 | Detrimental Gene Expression | ASO | Knockdown of Detrimental Gene Expression |
| Cancer | ERBB2 | Detrimental Gene Expression | ASO | Knockdown of Detrimental Gene Expression |
| Cancer | FLT1 | Detrimental Gene Expression | ASO | Knockdown of Detrimental Gene Expression |
| Cancer | HNRNPH1 | Detrimental Gene Expression | ASO | Knockdown of Detrimental Gene Expression |
| Cancer | KDR | Detrimental Gene Expression | ASO | Knockdown of Detrimental Gene Expression |
| Cancer | SRA1 | Detrimental Gene Expression | ASO | Knockdown of Detrimental Gene Expression |
| Cancer | STAT3 | Detrimental Gene Expression | ASO | Knockdown of Detrimental Gene Expression |
| Cancer | TERT | Detrimental Gene Expression | ASO | Knockdown of Detrimental Gene Expression |

TABLE ES3-continued

| | | | | |
|---|---|---|---|---|
| Cancer | WT1 | Detrimental Gene Expression | ASO | Knockdown of Detrimental Gene Expression |
| FHBL/atherosclerosis | APOB | Detrimental Gene Expression | ASO | Knockdown of Detrimental Gene Expression |
| Immune-response | CD40 | Detrimental Gene Expression | ASO | Knockdown of Detrimental Gene Expression |
| Inflammatory disease | TNFRSF1B | Detrimental Gene Expression | ASO | Knockdown of Detrimental Gene Expression |
| Inflammatory disease | IL5RA | Detrimental Gene Expression | ASO | Knockdown of Detrimental Gene Expression |
| Influenza virus | TMPRSS2 | Detrimental Gene Expression | ASO | Knockdown of Detrimental Gene Expression |
| Muscle wasting diseases | MSTN | Detrimental Gene Expression | ASO | Knockdown of Detrimental Gene Expression |
| Spinocerebellar ataxia type 1 | ATXN1 | Detrimental Gene Expression | ASO | Knockdown of Detrimental Gene Expression |
| Duchenne muscular dystrophy | DMD | RNA Reframing | ASO | RNA Reframing |
| Dystrophic epidermolysis bullosa | COL7A1 | RNA Reframing | ASO | RNA Reframing |
| Miyoshi myopathy | DYSF | RNA Reframing | ASO | RNA Reframing |

| | | |
|---|---|---|
| Beta-thalassemia | HBB | Splice Site Mutations |
| Alzheimer's disease/FTDP-17 Taupathies | MAPT | Deregulated Alternative Splicing |
| Spinal muscular atrophy | SMN2 | Deregulated Alternative Splicing |
| Dystrophic epidermolysis bullosa | COL7A1 | RNA Reframing |
| Familial dysautonomia | IKBKAP | Splice Site Mutations |
| Cystic fibrosis | CFTR | Cryptic Splice Sites |
| Neurofibromatosis | NF1 | Regulatory Sequence Mutations |
| Alzheimer's disease/FTDP-17 Taupathies | MAPT | Deregulated Alternative Splicing |
| Cancer | Multiple | Deregulated Alternative Splicing |
| Spinal muscular atrophy | SMN2 | Deregulated Alternative Splicing |
| Cancer | CDKN1A | Detrimental Gene Expression |
| Cancer | MYC | Detrimental Gene Expression |
| Cancer | Multiple | Detrimental Gene Expression |
| Cancer | PHB | Detrimental Gene Expression |
| Duchenne muscular dystrophy | DMD | RNA Reframing |
| Cystic Fibrosis | CFTR | Splice Site Mutations |
| Factor VII deficiency | F7 | Splice Site Mutations |
| Fanconi anemia | FANCC | Splice Site Mutations |
| Hemophilia A | F9 | Splice Site Mutations |
| Propionic acidemia | PCCA | Splice Site Mutations |
| Retinitis pigmentosa | RHO | Splice Site Mutations |
| Retinitis pigmentosa | RPGR | Splice Site Mutations |
| Spinal muscular atrophy | SMN2 | Deregulated Alternative Splicing |
| Bardet-Biedl syndrome | BBS1 | Splice Site Mutations |

| Disease | Human Target Gene | Therapeutic | Stage |
|---|---|---|---|
| Bardet-Biedl syndrome | BBS1 | U1/U6 snRNA* | Patient cells |
| Beta-thalassemia | HBB | PTM | Minigene |
| Cancer | BRCA1 | ASO | Minigene |
| Cancer | PTCH1 | ASO | Minigene |
| Cystic Fibrosis | CFTR | U1 snRNA* | Minigene |
| Duchenne muscular dystrophy | DMD | ASO | Canine model |
| Factor VII deficiency | F7 | U1 snRNA* | Minigene |
| Familial dysautonomia | IKBKAP | SM | Patients |

TABLE ES3-continued

| | | | |
|---|---|---|---|
| Fanconi anemia | FANCC | U1 snRNA* | Patient cells |
| Hemophilia A | F9 | U1 snRNA* | Minigene |
| Propionic acidemia | PCCA | U1 snRNA* | Patient cells |
| Retinitis pigmentosa | RHO | U1 snRNA* | Minigenes |
| Retinitis pigmentosa | RPGR | U1 snRNA* | Patient cells |
| Ataxia telangiectasia | ATM | ASO | Patient cells |
| Beta-thalassemia | HBB | ASO | Mouse model |
| Cancer | BRCA2 | ASO | Minigene |
| CDG1A | PMM2 | ASO | Patient cells |
| Congenital adrenal insufficiency | CYP11A | ASO | Minigene |
| Cystic fibrosis | CFTR | ASO | Cell lines |
| Cystic fibrosis | CFTR | SM | Patient cells |
| Duchenne muscular dystrophy | DMD | ASO | Patient cells |
| Fukuyama congenital muscular dystrophy (FCMD) | FKTN | ASO | Mouse model |
| Growth hormone insensitivity | GHR | ASO | Minigene |
| HPABH4A | PTS | ASO | Patient cells |
| Hutchinson-Gilford progeria (HGPS) | LMNA | ASO | Mouse model |
| MLC1 | MLC1 | ASO | Minigene |
| Methylmalonic aciduria | MUT | ASO | Patient cells |
| Myopathy with lactic acidosis | ISCU | ASO | Patient cells |
| Myotonic dystrophy | CLC1 | ASO | Mouse model |
| Neurofibromatosis | NF1 | ASO | Patient cells |
| Niemann-Pick type C | NPC1 | ASO | Patient cells |
| Propionic acidemia | PCCB | ASO | Patient cells |
| Usher syndrome | USH1C | ASO | Mouse model |
| Afibrinogenemia | FGB | ASO | Minigene |
| Cancer | BRCA1 | ASO | In vitro |
| Propionic acidemia | PCCA | ASO | Patient cells |
| Neurofibromatosis | NF1 | SM | Patient cells |
| Ocular albinism type 1 | GRP143 | ASO | Patient cells |
| Alzheimer's disease/FTDP-17 Taupathies | MAPT | ASO | Cell lines |
| Alzheimer's disease/FTDP-17 Taupathies | MAPT | PTM | Minigene |
| Alzheimer's disease/FTDP-17 Taupathies | MAPT | SM | Cell lines |
| Cancer | BCL2L1 | ASO | Mouse model |
| Cancer | FGFR1 | ASO | Cell lines |
| Cancer | MCL1 | ASO | Cell lines |
| Cancer | MDM2 | ASO | Cell lines |
| Cancer | Multiple | SM | Cell lines |
| Cancer | PKM | ASO | Cell lines |
| Cancer | MST1R | ASO | Cell lines |
| Cancer | USP5 | ASO | Cell lines |
| Spinal muscular atrophy | SMN2 | ASO | Clinical |
| Spinal muscular atrophy | SMN2 | SM | Clincal trials |
| Spinal muscular atrophy | SMN2 | U1 snRNA* | Minigene |
| Spinal muscular atrophy | SMN2 | PTM | Mouse model |
| Alzheimer's disease | BACE1 | ASO | Cell lines |
| Cancer | CDKN1A | SM | Cell lines |
| Cancer | ERBB2 | ASO | Cell lines |
| Cancer | FLT1 | ASO | Mouse model |
| Cancer | HNRNPH1 | ASO | Patient cells |
| Cancer | KDR | ASO | Mouse model |
| Cancer | MYC | SM | Cell lines |
| Cancer | Multiple | SM | Clinical trials phase I, E7107 |
| Cancer | PHB | SM | Cell lines |
| Cancer | SRA1 | ASO | Cell lines |
| Cancer | STAT3 | ASO | Mouse model |
| Cancer | TERT | ASO | Cell lines |
| Cancer | WT1 | ASO | Cell lines |
| FHBL/atherosclerosis | APOB | ASO | Cell lines |
| Immune-response | CD40 | ASO | Cell lines |
| Inflammatory disease | TNFRSF1B | ASO | Mouse model |
| Inflammatory disease | IL5RA | ASO | Cell lines |
| Influenza virus | TMPRSS2 | ASO | Cell lines |
| Muscle wasting diseases | MSTN | ASO | Mouse model |
| Spinocerebellar ataxia type 1 | ATXN1 | ASO | Cell lines |
| Duchenne muscular dystrophy | DMD | ASO | Clinical |
| Duchenne muscular dystrophy | DMD | SM | Cell lines |
| Dystrophic epidermolysis bullosa | COL7A1 | ASO | Explants |
| Dystrophic epidermolysis bullosa | COL7A1 | PTM | Patient cells |
| Miyoshi myopathy | DYSF | ASO | Patient cells |

In some embodiments, a provided oligonucleotide composition is administered at a dose and/or frequency lower than that of an otherwise comparable reference oligonucleotide composition with comparable effect in altering the splicing of a target transcript. In some embodiments, a stereocontrolled oligonucleotide composition is administered at a dose and/or frequency lower than that of an otherwise comparable stereorandom reference oligonucleotide composition with comparable effect in altering the splicing of the target transcript. If desired, a provided composition can also be administered at higher dose/frequency due to its lower toxicities.

In some embodiments, the present disclosure recognizes that properties, e.g., activities, toxicities, etc. of oligonucleotides and compositions thereof can be optimized by chemical modifications and/or stereochemistry. In some embodiments, the present disclosure provides methods for optimizing oligonucleotide properties through chemical modifications and stereochemistry. In some embodiments, the present disclosure provides oligonucleotides and compositions and methods thereof with low toxicities. In some embodiments, the present disclosure provides oligonucleotides and compositions and methods thereof with low toxicities and enhanced activities (e.g., target-inhibition efficiency, specificity, cleavage rates, cleavage pattern, etc.). In some embodiments, the present disclosure provides oligonucleotides and compositions and methods thereof with improved protein binding profile. In some embodiments, the present disclosure provides oligonucleotides and compositions and methods thereof with improved protein binding profile and enhanced activities. In some embodiments, the present disclosure provides oligonucleotides and compositions and methods thereof with improved delivery and enhanced activities.

In some embodiments, provided oligonucleotides, compositions and methods have low toxicities, e.g., when compared to a reference composition. As widely known in the art, oligonucleotides can induce toxicities when administered to, e.g., cells, tissues, organism, etc. In some embodiments, oligonucleotides can induce undesired immune response. In some embodiments, oligonucleotide can induce complement activation. In some embodiments, oligonucleotides can induce activation of the alternative pathway of complement. In some embodiments, oligonucleotides can induce inflammation. Among other things, the complement system has strong cytolytic activity that can damages cells and should therefore be modulated to reduce potential injuries. In some embodiments, oligonucleotide-induced vascular injury is a recurrent challenge in the development of oligonucleotides for e.g., pharmaceutical use. In some embodiments, a primary source of inflammation when high doses of oligonucleotides are administered involves activation of the alternative complement cascade. In some embodiments, complement activation is a common challenge associated with phosphorothioate-containing oligonucleotides, and there is also a potential of some sequences of phosphorothioates to induce innate immune cell activation. In some embodiments, cytokine release is associated with administration of oligonucleotides. For example, in some embodiments, increases in interleukin-6 (IL-6) monocyte chemoattractant protein (MCP-1) and/or interleukin-12 (IL-12) is observed. See, e.g., Frazier, Antisense Oligonucleotide Therapies: The Promise and the Challenges from a Toxicologic Pathologist's Perspective. *Toxicol Pathol.,* 43: 78-89, 2015; and Engelhardt, et al., Scientific and Regulatory Policy Committee Points-to-consider Paper: Drug-induced Vascular Injury Associated with Nonsmall Molecule Therapeutics in Preclinical Development: Part 2. Antisense Oligonucleotides. *Toxicol Pathol.* 43: 935-944, 2015.

By controlling of chemical modifications and/or stereochemistry, the present disclosure provides improved oligonucleotide compositions and methods. In some embodiments, provided oligonucleotides comprise chemical modifications. In some embodiments, provided oligonucleotides comprise base modifications, sugar modifications, internucleotidic linkage modifications, or any combinations thereof. In some embodiments, provided oligonucleotides comprise base modifications. In some embodiments, provided oligonucleotides comprise sugar modifications. In some embodiments, provided oligonucleotides comprises 2'-modifications on the sugar moieties. In some embodiments, the present disclosure demonstrates that 2'-modifications can lower toxicity. In some embodiments, provided oligonucleotides comprises one or more modified internucleotidic linkages and one or more natural phosphate linkages. In some embodiments, the present disclosure demonstrates that incorporation of one or more natural phosphate linkages into oligonucleotides comprising one or more modified internucleotidic linkages can lower toxicity. A natural phosphate linkage can be incorporated into various locations of an oligonucleotide. In some embodiments, a natural phosphate linkage is incorporated into a wing region, or a region close to the 5'- or the 3'-end. In some embodiments, a natural phosphate linkage is incorporated into the middle of an oligonucleotide. In some embodiments, a natural phosphate linkage is incorporated into a core region. In some embodiments, the present disclosure demonstrates that stereochemistry, either alone or in combination with chemical modifications, can modulate toxicity. In some embodiments, the present disclosure demonstrates that stereochemistry, either alone or in combination with chemical modifications, can modulate immune response. In some embodiments, the present disclosure demonstrates that stereochemistry, either alone or in combination with chemical modifications, can modulate complement activation. It is surprisingly found that a chirally controlled oligonucleotide composition of an individual stereoisomer can have dramatically different toxicity profile, e.g., complement activation, compared to the corresponding stereorandom composition, and/or a chirally controlled oligonucleotide composition of another individual stereoisomer. In some embodiments, the present disclosure demonstrates that stereochemistry, either alone or in combination with chemical modifications, can modulate complement activation via the alternative pathway. Example chemical modifications, stereochemistry and patterns thereof are extensively described in this disclosure, and they can be used in combinations. Example compositions and methods of are also extensively described in this disclosure. A person having ordinary skill in the art understands that methods and compositions described herein can be used to either increase or decrease immune responses, including complement activation, relative to a reference composition.

In some embodiments, the present disclosure provides a method of administering an oligonucleotide composition comprising a first plurality of oligonucleotides having a common nucleotide sequence, the improvement that comprises:

administering an provided oligonucleotide composition comprising the first plurality of oligonucleotides that is characterized by reduced toxicity relative to a reference oligonucleotide composition of the same common nucleotide sequence.

In some embodiments, the present disclosure provides a method of administering an oligonucleotide composition comprising a first plurality of oligonucleotides having a common nucleotide sequence, the improvement that comprises:

administering an oligonucleotide composition comprising the first plurality of oligonucleotides that is chirally controlled and that is characterized by reduced toxicity relative to a reference oligonucleotide composition of the same common nucleotide sequence.

In some embodiments, the present disclosure provides a method of administering an oligonucleotide composition comprising a first plurality of oligonucleotides having a common nucleotide sequence, the improvement that comprises:

administering an oligonucleotide composition in which each oligonucleotide in the plurality comprises one or more modified sugar moieties and the composition is characterized by reduced toxicity relative to a reference oligonucleotide composition of the same common nucleotide sequence but lacking at least one of the one or more modified sugar moieties.

In some embodiments, the present disclosure provides a method of administering an oligonucleotide composition comprising a first plurality of oligonucleotides having a common nucleotide sequence, the improvement that comprises:

administering an oligonucleotide composition in which each oligonucleotide in the plurality includes one or more natural phosphate linkages and one or more modified phosphate linkages;

wherein the oligonucleotide composition is characterized by reduced toxicity when tested in at least one assay that is observed with an otherwise comparable reference composition whose oligonucleotides comprise fewer natural phosphate linkages.

In some embodiments, the present disclosure provides a method of administering an oligonucleotide composition comprising a first plurality of oligonucleotides having a common nucleotide sequence, the improvement that comprises:

administering an oligonucleotide composition in which each oligonucleotide in the plurality includes one or more natural phosphate linkages and one or more modified phosphate linkages;

wherein the oligonucleotide composition is characterized by reduced toxicity when tested in at least one assay that is observed with an otherwise comparable reference composition whose oligonucleotides do not comprise natural phosphate linkages.

In some embodiments, the present disclosure provides a method of administering an oligonucleotide composition comprising a first plurality of oligonucleotides having a common nucleotide sequence, the improvement that comprises: administering an oligonucleotide composition in which each oligonucleotide in the plurality comprises one or more modified sugar moieties and the composition is characterized by reduced toxicity relative to a reference oligonucleotide composition of the same common nucleotide sequence but lacking at least one of the one or more modified sugar moieties.

In some embodiments, the present disclosure provides a method comprising steps of administering to a subject an oligonucleotide composition comprising a first plurality of oligonucleotides each of which has a common base sequence and comprises a modified sugar moiety, wherein the oligonucleotide composition is characterized by reduced toxicity when tested in at least one assay that is observed with an otherwise comparable reference composition that comprises a reference plurality of oligonucleotides which have the same common base sequence but have no modified sugar moieties.

In some embodiments, the present disclosure provides a method comprising steps of administering to a subject an oligonucleotide composition comprising a first plurality of oligonucleotides each of which has a common base sequence and comprises one or more natural phosphate linkages and one or more modified phosphate linkages, wherein the oligonucleotide composition is characterized by reduced toxicity when tested in at least one assay that is observed with an otherwise comparable reference composition that comprises a reference plurality of oligonucleotides which have the same common base sequence but have no natural phosphate linkages.

In some embodiments, the present disclosure provides a method comprising steps of administering a chirally controlled oligonucleotide composition to a subject, wherein the chirally controlled oligonucleotide composition is characterized by reduced toxicity when tested in at least one assay that is observed with an otherwise comparable reference composition that includes a different chirally controlled oligonucleotide composition, or a stereorandom oligonucleotide composition, comprising oligonucleotides having the same base sequence.

In some embodiments, reduced toxicity is or comprises reduced complement activation. In some embodiments, reduced toxicity comprises reduced complement activation. In some embodiments, reduced toxicity is or comprises reduced complement activation. In some embodiments, reduced toxicity comprises reduced complement activation via the alternative pathway. In some embodiments, toxicity can be assessed through measuring levels of complement activation. In some embodiments, altered complement activation is observed in an assay that detects a protein whose level changes upon complement activation. In some embodiments, altered complement activation is observed in an assay that detects presence, absolute level and or relative levels of one or more complete-activation related product. In some embodiments, complement activation is observed in a serum. In some embodiments, complement activation is observed in human serum. In some embodiments, complement activation is observed in a primate serum. In some embodiments, complement activation is observed in monkey serum.

In some embodiments, complement activation is measured no more than 60 minutes after administration of oligonucleotides. In some embodiments, complement activation is measured no more than 50 minutes after administration of oligonucleotides. In some embodiments, complement activation is measured no more than 40 minutes after administration of oligonucleotides. In some embodiments, complement activation is measured no more than 30 minutes after administration of oligonucleotides. In some embodiments, complement activation is measured no more than 25 minutes after administration of oligonucleotides. In some embodiments, complement activation is measured no more than 20 minutes after administration of oligonucleotides. In some embodiments, complement activation is measured no more than 15 minutes after administration of oligonucleotides. In some embodiments, complement activation is measured no more than 10 minutes after administration of oligonucleotides. In some embodiments, complement activation is measured no more than 9 minutes after administration of oligonucleotides. In some embodiments, complement activation is measured no more than 8 minutes after administration of oligonucleotides. In some embodiments, complement activation is measured no more than 7 minutes after administration of oligonucleotides. In some embodiments, complement activation is measured no more than 6 minutes after administration of oligonucleotides. In some embodiments, complement activation is measured no more than 5 minutes after administration of oligonucleotides. In some embodiments, complement activation is measured no more than 4 minutes after administration of oligonucleotides. In some embodiments, complement activation is measured no more than 3 minutes after administration of oligonucleotides. In some embodiments, complement activation is measured no more than 2 minutes after administration of oligonucleotides. In some embodiments, complement activation is measured no more than 1 minute after administration of oligonucleotides. In some embodiments, complement activation is measured no more than 30 seconds after administration of oligonucleotides. In some embodiments, complement activation is measured no more than 20 seconds after administration of oligonucleotides. In some embodiments, complement activation is measured no more than 10 seconds after administration of oligonucleotides. In some embodiments, complement activation is measured no more than 5 seconds after administration of oligonucleotides.

In some embodiments, complement activation is measured 5 minutes after administration of oligonucleotides. In some embodiments, complement activation is measured 10 minutes after administration of oligonucleotides. In some embodiments, complement activation is measured 15 minutes after administration of oligonucleotides. In some embodiments, complement activation is measured 20 minutes after administration of oligonucleotides. In some embodiments, complement activation is measured 25 minutes after administration of oligonucleotides. In some embodiments, complement activation is measured 30 minutes after administration of oligonucleotides. In some embodiments, complement activation is measured 35 minutes after administration of oligonucleotides. In some embodiments, complement activation is measured 40 minutes after administration of oligonucleotides. In some embodiments, complement activation is measured 45 minutes after administration of oligonucleotides. In some embodiments, complement activation is measured 50 minutes after administration of oligonucleotides. In some embodiments, complement activation is measured 55 minutes after administration of oligonucleotides. In some embodiments, complement activation is measured 60 minutes after administration of oligonucleotides. In some embodiments, complement activation is measured at multiple time points after administration of oligonucleotides, for example, at two or more time points selected from 5, 10, 15, 20, 25, 30, 35, 40, 45, 50, 55, 60, 70, 80, 90, 100, 110 and 120 minutes after administration of oligonucleotides.

In some embodiments, complement activation is reduced by at least 10%, 20%, 30%, 40%, 50%, 60%, 70%, 80%, 90%, 95%, 96%, 97%, 98% or 99%. In some embodiments, complement activation is reduced by at least 5%. In some embodiments, complement activation is reduced by at least 10%. In some embodiments, complement activation is reduced by at least 15%. In some embodiments, complement activation is reduced by at least 20%. In some embodiments, complement activation is reduced by at least 25%. In some embodiments, complement activation is reduced by at least 30%. In some embodiments, complement activation is reduced by at least 35%. In some embodiments, complement activation is reduced by at least 40%. In some embodiments, complement activation is reduced by at least 45%. In some embodiments, complement activation is reduced by at least 50%. In some embodiments, complement activation is reduced by at least 55%. In some embodiments, complement activation is reduced by at least 60%. In some embodiments, complement activation is reduced by at least 65%. In some embodiments, complement activation is reduced by at least 70%. In some embodiments, complement activation is reduced by at least 75%. In some embodiments, complement activation is reduced by at least 80%. In some embodiments, complement activation is reduced by at least 85%. In some embodiments, complement activation is reduced by at least 90%. In some embodiments, complement activation is reduced by at least 95%. In some embodiments, complement activation is reduced by at least 96%. In some embodiments, complement activation is reduced by at least 97%. In some embodiments, complement activation is reduced by at least 98%. In some embodiments, complement activation is reduced by at least 99%. In some embodiments, complement activation is reduced to the same level of a negative control, e.g., water, a buffer not inducing complement activation, etc. In some embodiments, provided oligonucleotides, compositions and methods reduce injection site inflammation. In some embodiments, provided oligonucleotides, compositions and methods reduce induced vascular injury.

Markers that can be used to evaluate toxicity are widely known in the art, for example, CH50 (total complement), complement split products (e.g., Bb, $C_3a$, $C_5a$, etc.), MCP-1 and CRP, fibrinogen, haptoglobin, globulin, proteinuria, albuminuria, Angiopoietin-2, Endothelin-1, Eselectin, Thrombospondin-1, Vascular endothelial growth factor alpha, Calponin-1, Tissue inhibitor of metalloproteinase 1, Lipocalin 2, Cytokine-induced neutrophil chemoattractant 1, Alpha-1 acid glycoprotein 1, total nitric oxide, Von Willebrands factor, intercellular adhesion molecule (ICAM), vascular cellular adhesion molecule-1 (VCAM-1), interleukins, monocyte chemotactic protein-1, serum amyloid A, CRP, fibrinogen, plasminogen activator inhibitor-1, caveolin, matrix metalloproteinases (MMP-1, MMP-3, and MMP-9), vascular endothelial growth factor, thrombomodulin, E-selectin, P-selectin, complement pathway analysis and other inflammatory markers (i.e., CRP, MCP-1, MMP-3, and/or other cytokines or chemokines), markers of endothelial activation (e.g., VCAM), etc. For examples, see Frazier, Antisense Oligonucleotide Therapies: The Promise and the Challenges from a Toxicologic Pathologist's Perspective. *Toxicol Pathol.,* 43: 78-89, 2015; Engelhardt, et al., Scientific and Regulatory Policy Committee Points-to-consider Paper: Drug-induced Vascular Injury Associated with Nonsmall Molecule Therapeutics in Preclinical Development: Part 2. Antisense Oligonucleotides. *Toxicol Pathol.* 43: 935-944, 2015; etc. In some embodiments, a marker is protein in the complement pathway. In some embodiments, a marker is protein in the alternative complement pathway. In some embodiments, a marker is protein produced during complete activation. In some embodiments, a marker is protein produced during complete activation via the alternative pathway. In some embodiments, a marker is selected from C3a, Bb, C4a, C5a, C5b, C6, C7, C8 and C9. In some embodiments, a marker is selected from C4a, C5a, C5b, C6, C7, C8 and C9. In some embodiments, a marker is selected from C3a, C4a, C5a and Bb. In some embodiments, a marker is C3a or Bb. In some embodiments, a marker is C3a. In some embodiments, a marker is Bb.

Example assays are widely known in the art, including but not limited to those described in this disclosure and US2002/

0082227; Frazier, Antisense Oligonucleotide Therapies: The Promise and the Challenges from a Toxicologic Pathologist's Perspective. *Toxicol Pathol.,* 43: 78-89, 2015; Engelhardt, et al., Scientific and Regulatory Policy Committee Points-to-consider Paper: Drug-induced Vascular Injury Associated with Nonsmall Molecule Therapeutics in Preclinical Development: Part 2. Antisense Oligonucleotides. *Toxicol Pathol.* 43: 935-944, 2015; etc.

The present disclosure demonstrates that chirally controlled oligonucleotide compositions of individual stereoisomers can have different complement activation profiles. In some embodiments, chirally controlled oligonucleotide compositions of oligonucleotides having all phosphorothioate linkages and a single Rp in the middle may demonstrate relatively high complement activation. As provided in this disclosure, various methods can be used to decrease the relatively high complement activation of these oligonucleotides, including but not limited to introduction of one or more natural phosphate linkages. For examples, see FIGS. 4 and 5.

With their improved properties, e.g., low toxicity, high activities, etc., provided oligonucleotides and compositions thereof are particularly useful for treating various diseases. In some embodiments, provided oligonucleotides, compositions and/or methods are particularly useful for reducing a target involved in the complement system. In some embodiments, provided oligonucleotides, compositions and/or methods are particularly useful for reducing complement activation by reducing levels of a target in the complement system as provided oligonucleotides, compositions and/or methods themselves only induce low, if any, complement activation compared to reference oligonucleotides, compositions and/or methods thereof. In some embodiments, a target involved in the complement system is C1, C1a, C1r, C1s, C1q, MASP-1, MASP-2, C3, C3-convertase, C3a, C3b, C3aR, C4b, C5, C5a, C5aR, Factor B, Factor D, Thrombin, Plasmin, Kallikrein, or Factor XIIa. In some embodiments, provided oligonucleotides, compositions and/or methods can provide improved treatment of associated diseases such as neuroinflammation and neurodegeneration, muscular inflammation, demyelination, vasculitis and nephritis. In some embodiments, a disease is a rare disease associated with complement; for examples, see Reis et al., Applying complement therapeutics to rare diseases, Clinical Immunology (2015), doi: 10.1016/j.clim.2015.08.009. In some embodiments, the present disclosure provides compositions of oligonucleotides targeting C5. In some embodiments, a provided composition is an siRNA composition targeting C5. In some embodiments, the present disclosure provides compositions of oligonucleotides targeting factor B. In some embodiments, the present disclosure provides compositions and methods targeting factor B for treatment of lupus nephritis. Example base sequences for targeting factor B include but are not limited to those described in Grossman et al. Inhibition of the alternative complement pathway by antisense oligonucleotides targeting complement factor B improves lupus nephritis in mice. *Immunobiology.* 2015 Aug. 10. pii: S0171-2985(15)30041-3. doi: 10.1016/j.imbio.2015.08.001.

In some embodiments, the present disclosure provides methods for modulating protein binding properties of oligonucleotides, for example, by adjusting chemical modifications and/or stereochemistry of oligonucleotides. Example chemical modifications, stereochemistry and combinations thereof are extensively described in this disclosure. In some embodiments, the present disclosure provides oligonucleotides and compositions thereof with improved protein binding profile.

In some embodiments, the present disclosure provides a method, comprising administering a composition comprising a first plurality of oligonucleotides, which composition displays altered protein binding as compared with a reference composition comprising a plurality of oligonucleotides, each of which also has the common base sequence but which differs structurally from the oligonucleotides of the first plurality in that:

individual oligonucleotides within the reference plurality differ from one another in stereochemical structure; and/or at least some oligonucleotides within the reference plurality have a structure different from a structure represented by the plurality of oligonucleotides of the composition; and/or at least some oligonucleotides within the reference plurality do not comprise a wing region and a core region.

In some embodiments, the present disclosure provides a method of administering an oligonucleotide composition comprising a first plurality of oligonucleotides having a common nucleotide sequence, the improvement that comprises:

administering an oligonucleotide composition comprising a first plurality of oligonucleotides that is characterized by altered protein binding relative to a reference oligonucleotide composition of the same common nucleotide sequence.

In some embodiments, provided oligonucleotides and compositions increase beneficial protein binding. In some embodiments, provided oligonucleotides and compositions decrease harmful protein binding. In some embodiments, provided oligonucleotides and compositions increase beneficial protein binding and decrease detrimental protein binding.

In some embodiments, improved protein binding profile lower toxicities and improve activities of provided oligonucleotides and compositions. In some embodiments, lowered binding to negative regulators of complement pathways contribute to decreased complement activation. In some embodiments, lowered binding to certain proteins are associated with lower toxicities and/or better activities. In some embodiments, increased binding to certain proteins contributes to lower toxicities and/or better activities.

Binding to various proteins, e.g., serum proteins, heparin sulfate-binding proteins, intracellular proteins, etc., by oligonucleotides can be modulated using oligonucleotides, compositions and methods provided in the present disclosure. Example proteins include but are not limited to Albumin, Complement Factor H, Factor IX, ApoE, Thrombin, Factor VIIIa, Heparin Cofactor II, alpha-2 macroglobulin, Fibroblast Growth Factor 1, Fibroblast Growth Factor 2, Hepatocyte Growth Factor/Scatter Factor, Vascular Endothelial Growth Factor, High-Mobility Group Protein B1, Cyclophilin B, IL-8 (CXCL8), Platelet Factor 4 (CXCL4), Stromal Cell-Derived Factor-1 (CXCL12), Monocyte Chemoattractant Protein-1 (CCL2), Fibroblast Growth Factor Receptor 1, Neuropilin-1, Receptor for Advanced Glycation End Products, Receptor Protein Tyrosine Phosphatase Sigma, Slit-2, ROBO1, Thrombin, Antithrombin, Protein C inhibitor, Amyloid precursor protein 1, Thrombospondin-1, Annexin A2, PDGF BB, PC4/Sub1, RNF163/ZNF9, Ku70, Ku80, TCP1-alpha, TCP1-beta, TCP1-epsilon, TCP1-gamma, TCP1-Theta, TCP1-delta, HSP90-AA1, HSP90-AB, HSP70-5/GRP78, HSPAIL, HSC70, ACTB, TBBB2C, Vimentin, CArG Binding Factor, DHX30, EIF2S2, EIF4H, GRSF1, hnRNP D1L, hnRNPA1, hnRNPA2, hnRNPHI, hnRNPK, hnRNPQ, hnRNPU, hnRNPUL, ILF2, ILF3, KHSRP, La/SSB, NCL, NPM1, P54nrb, PSF, PSPC1, RHA, YBX1, ACLY, VARS, ANXA2, NDKA, Thymidylate Kinase, JKBP1 delta 6, SHMT2, LRP-PRC, NARS, ATAD3A, KCTD12, CD4, GP120, aMb2 (Mac-1), VDAC-1, Ago2 PAZ domain, RAGE, AIM2, DHX36, DHX9, DDX41, IFI16, RIG-I, MDA5, LRRFIP1, DLM-1/ZBP1, TREX1, Laminin, and Fibronectin. In some embodiments, a plurality of oligonucleotides or an oligonucleotide composition can simultaneously modulate binding to multiple proteins, including maintaining the same binding levels to one group of proteins, decreasing binding levels to another group of proteins, and/or increasing binding level to yet another group of proteins. In some embodiments, provided oligonucleotides, compositions and methods provide increased binding to one or more serum proteins. In some embodiments, a serum protein is albumin. In some embodiments, provided oligonucleotides, compositions and methods provide decreased binding to one or more heparin sulfate-binding protein. In some embodiments, provided oligonucleotides, compositions and methods provide decreased binding to one or more Factor H.

In some embodiments, protein binding is decreased by more than 10%. In some embodiments, protein binding is decreased by more than 20%. In some embodiments, protein binding is decreased by more than 30%. In some embodiments, protein binding is decreased by more than 40%. In some embodiments, protein binding is decreased by more than 50%. In some embodiments, protein binding is decreased by more than 60%. In some embodiments, protein binding is decreased by more than 70%. In some embodiments, protein binding is decreased by more than 75%. In some embodiments, protein binding is decreased by more than 80%. In some embodiments, protein binding is decreased by more than 85%. In some embodiments, protein binding is decreased by more than 90%. In some embodiments, protein binding is decreased by more than 91%. In some embodiments, protein binding is decreased by more than 92%. In some embodiments, protein binding is decreased by more than 93%. In some embodiments, protein binding is decreased by more than 94%. In some embodiments, protein binding is decreased by more than 95%. In some embodiments, protein binding is decreased by more than 96%. In some embodiments, protein binding is decreased by more than 97%. In some embodiments, protein binding is decreased by more than 98%. In some embodiments, protein binding is decreased by more than 99%.

In some embodiments, protein binding is increased by more than 10%. In some embodiments, protein binding is increased by more than 20%. In some embodiments, protein binding is increased by more than 30%. In some embodiments, protein binding is increased by more than 40%. In some embodiments, protein binding is increased by more than 50%. In some embodiments, protein binding is increased by more than 60%. In some embodiments, protein binding is increased by more than 70%. In some embodiments, protein binding is increased by more than 80%. In some embodiments, protein binding is increased by more than 90%. In some embodiments, protein binding is increased by more than 100%. In some embodiments, protein binding is increased by more than 150%. In some embodiments, protein binding is increased by more than 2 fold. In some embodiments, protein binding is increased by more than 3 fold. In some embodiments, protein binding is increased by more than 4 fold. In some embodiments, protein binding is increased by more than 5 fold. In some embodiments, protein binding is increased by more than 6 fold. In some embodiments, protein binding is increased by more than 7 fold. In some embodiments, protein binding is increased by more than 8 fold. In some embodiments, protein binding is increased by more than 9 fold. In some embodiments, protein binding is increased by more than 10 fold. In some embodiments, protein binding is increased by more than 15 fold. In some embodiments, protein binding is increased by more than 20 fold. In some embodiments, protein binding is increased by more than 25 fold. In some embodiments, protein binding is increased by more than 30 fold. In some embodiments, protein binding is increased by more than 35 fold. In some embodiments, protein binding is increased by more than 40 fold. In some embodiments, protein binding is increased by more than 45 fold. In some embodiments, protein binding is increased by more than 50 fold. In some embodiments, protein binding is increased by more than 60 fold. In some embodiments, protein binding is increased by more than 70 fold. In some embodiments, protein binding is increased by more than 80 fold. In some embodiments, protein binding is increased by more than 90 fold. In some embodiments, protein binding is increased by more than 100 fold.

In some embodiments, the present disclosure provides assays for assessing protein binding. In some embodiments, protein binding can be assessed by binding to albumin. In some embodiments, protein binding can be assessed by binding to BSA. In some embodiments, protein binding can be assessed in vitro. Additional suitable assays are widely known in the art.

Chemical modifications, stereochemistry and combinations thereof that can improve protein binding profiles are extensively described in this disclosure. In some embodiments, more modified internucleotidic linkages can increase protein binding. In some embodiments, more phosphorothioate linkages can increase protein binding. In some embodiments, fewer modified internucleotidic linkages can decrease protein binding. In some embodiments, fewer phosphorothioate linkages can decrease protein binding. In some embodiments, more Sp chiral internucleotidic linkages increase protein binding. In some embodiments, fewer Sp chiral internucleotidic linkages decrease protein binding. In some embodiments, more modified bases increase protein binding. In some embodiments, fewer modified bases decrease protein binding. In some embodiments, one type of sugar modifications can increase protein binding compared to the other. In some embodiments, increased 2'-MOE content decrease protein biding when compared to 2'-OMe. The present disclosure provides numerous combinations of chemical modifications and/or stereochemistry patterns to improve protein binding profiles. In some embodiments, the present disclosure provides numerous combinations of chemical modifications and/or stereochemistry patterns to improve protein binding profiles while at the same time providing lower toxicities and/or better activities. Example oligonucleotides and compositions having these modifications, stereochemistry, or combinations thereof are described herein in this disclosure.

Delivery of oligonucleotides to targets can benefit from improved protein binding profile. In some embodiments, improved binding properties to certain proteins facilitate transportation of oligonucleotides to target cells, tissues, organs or organism. In some embodiments, improved binding properties to certain proteins promote release of oligonucleotides from proteins and other molecules so that they can perform their biological functions, including hybridization to target nucleic acid sequences, inhibition of functions of target nucleic acid sequences, cleavage of target nucleic acid sequences, etc. In some embodiments, provided oligonucleotides, compositions and methods provide improved uptake of oligonucleotides. In some embodiments, provided oligonucleotides, compositions and methods provide improved uptake of oligonucleotides.

In some embodiments, the present disclosure provides a method comprising administering a composition comprising a first plurality of oligonucleotides, which composition displays improved delivery as compared with a reference composition comprising a plurality of oligonucleotides, each of which also has the common base sequence but which differs structurally from the oligonucleotides of the first plurality in that:

individual oligonucleotides within the reference plurality differ from one another in stereochemical structure; and/or at least some oligonucleotides within the reference plurality have a structure different from a structure represented by the plurality of oligonucleotides of the composition; and/or at least some oligonucleotides within the reference plurality do not comprise a wing region and a core region.

In some embodiments, the present disclosure provides a method of administering an oligonucleotide composition comprising a first plurality of oligonucleotides having a common nucleotide sequence, the improvement that comprises:

administering an oligonucleotide comprising a first plurality of oligonucleotides that is characterized by improved delivery relative to a reference oligonucleotide composition of the same common nucleotide sequence.

In some embodiments, provided oligonucleotides, compositions and methods provide improved systemic delivery. In some embodiments, provided oligonucleotides, compositions and methods provide improved cytoplasmatic delivery. In some embodiments, improved delivery is to a population of cells. In some embodiments, improved delivery is to a tissue. In some embodiments, improved delivery is to an organ. In some embodiments, improved delivery is to an organism. Example structural elements (e.g., chemical modifications, stereochemistry, combinations thereof, etc.), oligonucleotides, compositions and methods that provide improved delivery are extensively described in this disclosure.

In some embodiments, the present disclosure provides methods for decreasing level of a target nucleic acid in a cell, tissue, and/or organism without low toxicity by contacting with a provided composition of this disclosure. In some embodiments, the present disclosure provides methods for decreasing level of a target nucleic acid in a cell, tissue, and/or organism without lower toxicity comparing to a reference composition by contacting with a provided composition of this disclosure. In some embodiments, the present disclosure provides methods for decreasing level of a target nucleic acid in a cell, tissue, and/or organism without significant complement activation by contacting with a provided composition of this disclosure. In some embodiments, the present disclosure provides methods for decreasing level of a target nucleic acid in a cell, tissue, and/or organism lower complement activation compared to a reference composition by contacting with a provided composition of this disclosure.

In some embodiments, the present disclosure provides methods for identifying and/or characterizing an oligonucleotide composition with improved properties, e.g., toxicities, activities, etc. In some embodiments, the present disclosure provides methods for identifying and/or characterizing an oligonucleotide composition with lower toxicities compared to a reference composition. In some embodiments, the present disclosure provides methods for identifying and/or characterizing an oligonucleotide composition with improved protein binding profiles compared to a reference composition.

In some embodiments, the present disclosure provides a method of identifying and/or characterizing an oligonucleotide composition, the method comprising steps of: providing at least one composition comprising a first plurality of oligonucleotides; and assessing toxicity relative to a reference composition.

In some embodiments, the present disclosure provides a method of identifying and/or characterizing an oligonucleotide composition, the method comprising steps of:

providing at least one composition comprising a first plurality of oligonucleotides; and assessing complement activation relative to a reference composition.

In some embodiments, the present disclosure provides a method of identifying and/or characterizing an oligonucleotide composition, the method comprising steps of:

providing at least one composition comprising a first plurality of oligonucleotides; and assessing protein binding profile relative to a reference composition.

In some embodiments, the present disclosure provides a method of identifying and/or characterizing an oligonucleotide composition, the method comprising steps of:

providing at least one composition comprising a first plurality of oligonucleotides; and assessing delivery relative to a reference composition.

In some embodiments, the present disclosure provides a method of identifying and/or characterizing an oligonucleotide composition, the method comprising steps of:

providing at least one composition comprising a first plurality of oligonucleotides; and assessing cellular uptake relative to a reference composition.

In some embodiments, properties of a provided oligonucleotide compositions are compared to a reference oligonucleotide composition. In some embodiments, a reference oligonucleotide composition comprises a reference plurality of oligonucleotides.

In some embodiments, a reference oligonucleotide composition is a stereorandom oligonucleotide composition. In some embodiments, a reference oligonucleotide composition is a stereorandom composition of oligonucleotides of which all internucleotidic linkages are phosphorothioate. In some embodiments, a reference oligonucleotide composition is a DNA oligonucleotide composition with all phosphate linkages.

In some embodiments, a reference composition is a composition of oligonucleotides having the same base sequence and the same chemical modifications. In some embodiments, a reference composition is a composition of oligonucleotides having the same base sequence and the same pattern of chemical modifications. In some embodiments, a reference composition is a chirally un-controlled (or stereorandom) composition of oligonucleotides having the same base sequence and chemical modifications.

In some embodiments, a reference composition is a composition of oligonucleotides having the same base sequence but different chemical modifications. In some embodiments, a reference composition is a composition of oligonucleotides having the same base sequence, base modifications, internucleotidic linkage modifications but different sugar modifications. In some embodiments, a reference composition has fewer 2'-modified sugar modifications. In some embodiments, a reference composition is a composition of oligonucleotides having the same base sequence, base modifications, sugar modifications but different internucleotidic linkage modifications. In some embodiments, a reference composition has more internucleotidic linkage modifications. In some embodiments, a reference composition has fewer natural phosphate linkages. In some embodiments, a reference composition comprising oligonucleotides having no natural phosphate linkages.

In some embodiments, a reference composition is a composition comprising a reference plurality of oligonucleotides wherein individual oligonucleotides within the reference plurality differ from one another in stereochemical structure. In some embodiments, a reference composition is a composition comprising a reference plurality of oligonucleotides, wherein at least some oligonucleotides within the reference plurality have a structure different from a structure represented by a plurality of oligonucleotides of a composition compared to the reference composition. In some embodiments, a reference composition is a composition comprising a reference plurality of oligonucleotides wherein at least some oligonucleotides within the reference plurality do not comprise a wing region and a core region.

In some embodiments, a reference oligonucleotide composition comprises a reference plurality of oligonucleotides having the same common nucleotide sequence but lacking at least one of the one or more modified sugar moieties in oligonucleotides of the oligonucleotide composition compared to the reference composition. In some embodiments, a reference oligonucleotide composition comprises a reference plurality of oligonucleotides having the same common nucleotide sequence but have no modified sugar moieties. In some embodiments, a reference oligonucleotide composition comprises a reference plurality of oligonucleotides having the same common nucleotide sequence but do not comprise natural phosphate linkages. In some embodiments, a reference composition is a chirally controlled oligonucleotide composition of oligonucleotides having the same chemical modification patterns. In some embodiments, a reference composition is a chirally controlled oligonucleotide composition of another stereoisomer.

In some embodiments, a reference oligonucleotide composition of a provided oligonucleotide composition is a comparable composition absence of the lipids in the provided composition. In some embodiments, a reference oligonucleotide composition is a stereorandom oligonucleotide composition. In some embodiments, a reference oligonucleotide composition is a stereorandom composition of oligonucleotides of which all internucleotidic linkages are phosphorothioate. In some embodiments, a reference oligonucleotide composition is a DNA oligonucleotide composition with all phosphate linkages. In some embodiments, a reference composition is a composition of oligonucleotides having the same base sequence and the same chemical modifications. In some embodiments, a reference composition is a composition of oligonucleotides having the same base sequence and the same pattern of chemical modifications. In some embodiments, a reference composition is a chirally un-controlled (or stereorandom) composition of oligonucleotides having the same base sequence and chemical modifications. In some embodiments, a reference composition is a composition of oligonucleotides having the same base sequence but different chemical modifications. In some embodiments, a reference composition is a composition of oligonucleotides having the same base sequence, base modifications, internucleotidic linkage modifications but different sugar modifications. In some embodiments, a reference composition has fewer 2'-modified sugar modifications. In some embodiments, a reference composition is a composition of oligonucleotides having the same base sequence, base modifications, sugar modifications but different internucleotidic linkage modifications. In some embodiments, a reference composition has more internucleotidic linkage modifications. In some embodiments, a reference composition has fewer natural phosphate linkages. In some embodiments, a reference composition comprising oligonucleotides having no natural phosphate linkages. In some embodiments, a reference composition is a composition comprising a reference plurality of oligonucleotides wherein individual oligonucleotides within the reference plurality differ from one another in stereochemical structure. In some embodiments, a reference composition is a composition comprising a reference plurality of oligonucleotides, wherein at least some oligonucleotides within the reference plurality have a structure different from a structure represented by a plurality of oligonucleotides of a composition compared to the reference composition. In some embodiments, a reference composition is a composition comprising a reference plurality of oligonucleotides wherein at least some oligonucleotides within the reference plurality do not comprise a wing region and a core region. In some embodiments, a reference oligonucleotide composition comprises a reference plurality of oligonucleotides having the same common nucleotide sequence but lacking at least one of the one or more modified sugar moieties in oligonucleotides of the oligonucleotide composition compared to the reference composition. In some embodiments, a reference oligonucleotide composition comprises a reference plurality of oligonucleotides having the same common nucleotide sequence but have no modified sugar moieties. In some embodiments, a reference oligonucleotide composition comprises a reference plurality of oligonucleotides having the same common nucleotide sequence but do not comprise natural phosphate linkages. In some embodiments, a reference composition is a chirally controlled oligonucleotide composition of oligonucleotides having the same chemical modification patterns. In some embodiments, a reference composition is a chirally controlled oligonucleotide composition of another stereoisomer.

In some embodiments, oligonucleotides of the first plurality comprise one or more structural elements (e.g., modifications, stereochemistry, patterns, etc.) that oligonucleotides of the reference plurality do not all have. Such structural elements can be any one described in this disclosure.

In some embodiments, oligonucleotides of the first plurality comprise more phosphorothioate linkages than oligonucleotides of the reference composition. In some embodiments, oligonucleotides of the first plurality comprise more phosphorothioate linkages than oligonucleotides of the reference composition at the 5'-end region. In some embodiments, oligonucleotides of the first plurality comprise more phosphorothioate linkages than oligonucleotides of the reference composition at the 3'-end region. In some embodiments, oligonucleotides of the first plurality comprise more phosphorothioate linkages in a wing region than the corresponding region of oligonucleotides of the reference composition. In some embodiments, oligonucleotides of the first plurality comprise more phosphorothioate linkages in each wing region than the corresponding regions in oligonucleotides of the reference composition. In some embodiments, oligonucleotides of the first plurality comprise more Sp chiral internucleotidic linkages than oligonucleotides of the reference composition. In some embodiments, oligonucleotides of the first plurality comprise more Sp phosphorothioate linkages than oligonucleotides of the reference composition. In some embodiments, oligonucleotides of the first plurality comprise more Sp phosphorothioate linkages than oligonucleotides of the reference composition at the 5'-end region. In some embodiments, oligonucleotides of the first plurality comprise more Sp phosphorothioate linkages than oligonucleotides of the reference composition at the 3'-end region. In some embodiments, oligonucleotides of the first plurality comprise more Sp phosphorothioate linkages in a wing region than oligonucleotides of the reference composition. In some embodiments, oligonucleotides of the first plurality comprise more Sp phosphorothioate linkages in each wing region than oligonucleotides of the reference composition. In some embodiments, oligonucleotides of the first plurality comprise more modified bases than oligonucleotides of the reference composition. In some embodiments, oligonucleotides of the first plurality comprise more methylated bases than oligonucleotides of the reference composition. In some embodiments, oligonucleotides of the first plurality comprise more methylated bases than oligonucleotides of the reference composition at the 5'-end region. In some embodiments, oligonucleotides of the first plurality comprise more methylated bases than oligonucleotides of the reference composition at the 3'-end region. In some embodiments, oligonucleotides of the first plurality comprise more methylated bases than in a wing region than oligonucleotides of the reference composition. In some embodiments, oligonucleotides of the first plurality comprise more methylated bases than in each wing region than oligonucleotides of the reference composition. In some embodiments, oligonucleotides of the first plurality comprise fewer 2'-MOE modifications than oligonucleotides of the reference composition. In some embodiments, oligonucleotides of the first plurality comprise fewer 2'-MOE modifications than oligonucleotides of the reference composition. In some embodiments, oligonucleotides of the first plurality comprise fewer 2'-MOE modifications than oligonucleotides of the reference composition at the 5'-end region. In some embodiments, oligonucleotides of the first plurality comprise fewer 2'-MOE modifications than oligonucleotides of the reference composition at the 3'-end. In some embodiments, oligonucleotides of the first plurality comprise fewer 2'-MOE modifications than in a wing region than oligonucleotides of the reference composition. In some embodiments, oligonucleotides of the first plurality comprise fewer 2'-MOE modifications than in each wing region than oligonucleotides of the reference composition. In some embodiments, individual oligonucleotides within the reference plurality differ from one another in stereochemical structure. In some embodiments, at least some oligonucleotides within the reference plurality have a structure different from a structure represented by the plurality of oligonucleotides of the composition. In some embodiments, at least some oligonucleotides within the reference plurality do not comprise a wing region and a core region. In some embodiments, the reference composition is a substantially racemic preparation of oligonucleotides that share the base sequence. In some embodiments, the reference composition is a chirally controlled oligonucleotide composition of another oligonucleotide type. In some embodiments, oligonucleotides of the reference composition comprise more phosphorothioate linkages. In some embodiments, oligonucleotides of the reference composition comprise only phosphorothioate linkages. In some embodiments, oligonucleotides of the reference composition comprise fewer modified sugar moieties. In some embodiments, oligonucleotides of the reference composition comprise fewer modified sugar moieties, wherein the modification is 2'-$OR^1$. In some embodiments, oligonucleotides of the reference composition comprise more modified sugar moieties. In some embodiments, oligonucleotides of the reference composition comprise more modified sugar moieties, the modification is 2'-$OR^1$. In some embodiments, oligonucleotides of the reference composition comprise fewer phosphorothioate linkages. In some embodiments, oligonucleotides of the reference composition have a wing, and comprise fewer phosphorothioate linkages at the wing. In some embodiments, oligonucleotides of the reference composition comprise fewer Sp phosphorothioate linkages. In some embodiments, oligonucleotides of the reference composition have a wing, and comprise fewer Sp phosphorothioate linkages at the wing. In some embodiments, oligonucleotides of the reference composition comprise more Rp phosphorothioate linkages. In some embodiments, oligonucleotides of the reference composition have a wing, and comprise more Rp phosphorothioate linkages at the wing. In some embodiments, oligonucleotides of the reference composition comprise fewer methylated bases. In some embodiments, oligonucleotides of the reference composition comprise more 2'-MOE modifications. In some embodiments, oligonucleotides of the reference composition comprise fewer natural phosphate linkages. In some embodiments, oligonucleotides of the reference composition comprise fewer natural phosphate linkages at the 5'- and/or 3'-end. In some embodiments, oligonucleotides of the reference composition comprise fewer natural phosphate linkages in a region corresponding to a wing of oligonucleotides of the first plurality. In some embodiments, oligonucleotides of the first plurality comprise natural phosphate linkages in a wing, and oligonucleotides of the reference composition comprise fewer natural phosphate linkages at the corresponding wing region. In some embodiments, oligonucleotides of the first plurality comprises natural phosphate linkages in a wing, and oligonucleotides of the reference composition comprises modified internucleotidic linkages at one or more such natural phosphate linkage locations in a wing. In some embodiments, oligonucleotides of the first plurality comprise natural phosphate linkages in a wing, and oligonucleotides of the reference composition comprises phosphorothioate linkages at one or more such natural phosphate linkage locations in a wing. In some embodiments, oligonucleotides of the reference composition comprise no natural phosphate linkages. In some embodiments, oligonucleotides of the reference composition comprise no wing-core-wing structure. In some embodiments, oligonucleotides of the first plurality comprise a 5'-end wing region comprising a natural phosphate linkage between the two nucleosides at its 3'-end, and oligonucleotides of a reference plurality do not have a natural phosphate linkage at the same position. In some embodiments, oligonucleotides of the first plurality comprise a 3'-end wing region comprising a natural phosphate linkage between the two nucleosides at its 5'-end, and oligonucleotides of a reference plurality do not have a natural phosphate linkage at the same position. In some embodiments, oligonucleotides of a provided composition comprise fewer 2'-MOE modifications than oligonucleotides of the reference composition. In some embodiments, oligonucleotides of a provided composition comprise fewer 2'-MOE modifications than oligonucleotides of the reference composition. In some embodiments, oligonucleotides of a provided composition comprise fewer 2'-MOE modifications than oligonucleotides of the reference composition at the 5'-end region. In some embodiments, oligonucleotides of a provided composition comprise fewer 2'-MOE modifications than oligonucleotides of the reference composition at the 3'-end. In some embodiments, oligonucleotides of a provided composition comprise fewer 2'-MOE modifications than in a wing region than oligonucleotides of the reference composition. In some embodiments, oligonucleotides of a provided composition comprise fewer 2'-MOE modifications than in each wing region than oligonucleotides of the reference composition. In some embodiments, individual oligonucleotides within the reference plurality differ from one another in stereochemical structure. In some embodiments, at least some oligonucleotides within the reference plurality have a structure different from a structure represented by the plurality of oligonucleotides of the composition. In some embodiments, at least some oligonucleotides within the reference plurality do not comprise a wing region and a core region. In some embodiments, the reference composition is a substantially racemic preparation of oligonucleotides that share the base sequence. In some embodiments, the reference composition is a chirally controlled oligonucleotide composition of another oligonucleotide type. In some embodiments, oligonucleotides of the reference composition comprise more phosphorothioate linkages. In some embodiments, oligonucleotides of the reference composition comprise only phosphorothioate linkages. In some embodiments, oligonucleotides of the reference composition comprise fewer modified sugar moieties. In some embodiments, oligonucleotides of the reference composition comprise fewer modified sugar moieties, wherein the modification is 2'-$OR^1$. In some embodiments, oligonucleotides of the reference composition comprise more modified sugar moieties. In some embodiments, oligonucleotides of the reference composition comprise more modified sugar moieties, the modification is 2'-$OR^1$. In some embodiments, oligonucleotides of the reference composition comprise fewer phosphorothioate linkages. In some embodiments, oligonucleotides of the reference composition have a wing, and comprise fewer phosphorothioate linkages at the wing. In some embodiments, oligonucleotides of the reference composition comprise fewer Sp phosphorothioate linkages. In some embodiments, oligonucleotides of the reference composition have a wing, and comprise fewer Sp phosphorothioate linkages at the wing. In some embodiments, oligonucleotides of the reference composition comprise more Rp phosphorothioate linkages. In some embodiments, oligonucleotides of the reference composition have a wing, and comprise more Rp phosphorothioate linkages at the wing. In some embodiments, oligonucleotides of the reference composition comprise fewer methylated bases. In some embodiments, oligonucleotides of the reference composition comprise more 2'-MOE modifications. In some embodiments, oligonucleotides of the reference composition comprise fewer natural phosphate linkages. In some embodiments, oligonucleotides of the reference composition comprise fewer natural phosphate linkages at the 5'- and/or 3'-end. In some embodiments, oligonucleotides of the reference composition comprise fewer natural phosphate linkages in a region corresponding to a wing of oligonucleotides of the first plurality. In some embodiments, oligonucleotides of a provided composition comprise natural phosphate linkages in a wing, and oligonucleotides of the reference composition comprise fewer natural phosphate linkages at the corresponding wing region. In some embodiments, oligonucleotides of a provided composition comprises natural phosphate linkages in a wing, and oligonucleotides of the reference composition comprises modified internucleotidic linkages at one or more such natural phosphate linkage locations in a wing. In some embodiments, oligonucleotides of a provided composition comprise natural phosphate linkages in a wing, and oligonucleotides of the reference composition comprises phosphorothioate linkages at one or more such natural phosphate linkage locations in a wing. In some embodiments, oligonucleotides of the reference composition comprise no natural phosphate linkages. In some embodiments, oligonucleotides of the reference composition comprise no wing-core-wing structure. In some embodiments, oligonucleotides of a provided composition comprise a 5'-end wing region comprising a natural phosphate linkage between the two nucleosides at its 3'-end, and oligonucleotides of a reference plurality do not have a natural phosphate linkage at the same position. In some embodiments, oligonucleotides of a provided composition comprise a 3'-end wing region comprising a natural phosphate linkage between the two nucleosides at its 5'-end, and oligonucleotides of a reference plurality do not have a natural phosphate linkage at the same position. In some embodiments, oligonucleotides of a reference plurality comprise fewer nucleotidic units comprising —F. In some embodiments, oligonucleotides of a reference plurality comprise fewer 2'-F modified sugar moieties. In some embodiments, oligonucleotides of a reference plurality comprise fewer chirally controlled modified internucleotidic linkages.

In some embodiments, provided chirally controlled oligonucleotide compositions comprises oligonucleotides of one oligonucleotide type. In some embodiments, provided chirally controlled oligonucleotide compositions comprises oligonucleotides of only one oligonucleotide type. In some embodiments, provided chirally controlled oligonucleotide compositions has oligonucleotides of only one oligonucleotide type. In some embodiments, provided chirally controlled oligonucleotide compositions comprises oligonucleotides of two or more oligonucleotide types. In some embodiments, using such compositions, provided methods can target more than one target. In some embodiments, a chirally controlled oligonucleotide composition comprising two or more oligonucleotide types targets two or more targets. In some embodiments, a chirally controlled oligonucleotide composition comprising two or more oligonucleotide types targets two or more mismatches. In some embodiments, a single oligonucleotide type targets two or more targets, e.g., mutations. In some embodiments, a target region of oligonucleotides of one oligonucleotide type comprises two or more "target sites" such as two mutations or SNPs.

In some embodiments, oligonucleotides in a provided chirally controlled oligonucleotide composition optionally comprise modified bases or sugars. In some embodiments, a provided chirally controlled oligonucleotide composition does not have any modified bases or sugars. In some embodiments, a provided chirally controlled oligonucleotide composition does not have any modified bases. In some embodiments, oligonucleotides in a provided chirally controlled oligonucleotide composition comprise modified bases and sugars. In some embodiments, oligonucleotides in a provided chirally controlled oligonucleotide composition comprise a modified base. In some embodiments, oligonucleotides in a provided chirally controlled oligonucleotide composition comprise a modified sugar. Modified bases and sugars for oligonucleotides are widely known in the art, including but not limited in those described in the present disclosure. In some embodiments, a modified base is 5-mC. In some embodiments, a modified sugar is a 2'-modified sugar. Suitable 2'-modification of oligonucleotide sugars are widely known by a person having ordinary skill in the art. In some embodiments, 2'-modifications include but are not limited to 2'-$OR^1$, wherein $R^1$ is not hydrogen. In some embodiments, a 2'-modification is 2'-$OR^1$, wherein $R^1$ is optionally substituted $C_{1-6}$ aliphatic. In some embodiments, a 2'-modification is 2'-MOE. In some embodiments, a modification is 2'-halogen. In some embodiments, a modification is 2'-F. In some embodiments, modified bases or sugars may further enhance activity, stability and/or selectivity of a chirally controlled oligonucleotide composition, whose common pattern of backbone chiral centers provides unexpected activity, stability and/or selectivity.

In some embodiments, a provided chirally controlled oligonucleotide composition does not have any modified sugars. In some embodiments, a provided chirally controlled oligonucleotide composition does not have any 2'-modified sugars. In some embodiments, the present disclosure surprising found that by using chirally controlled oligonucleotide compositions, modified sugars are not needed for stability, activity, and/or control of cleavage patterns. Furthermore, in some embodiments, the present disclosure surprisingly found that chirally controlled oligonucleotide compositions of oligonucleotides without modified sugars deliver better properties in terms of stability, activity, turnover and/or control of cleavage patterns. For example, in some embodiments, it is surprising found that chirally controlled oligonucleotide compositions of oligonucleotides having no modified sugars dissociates much faster from cleavage products and provide significantly increased turnover than compositions of oligonucleotides with modified sugars.

As discussed in detail herein, the present disclosure provides, among other things, a chirally controlled oligonucleotide composition, meaning that the composition contains a plurality of oligonucleotides of at least one type. Each oligonucleotide molecule of a particular "type" is comprised of preselected (e.g., predetermined) structural elements with respect to: (1) base sequence; (2) pattern of backbone linkages; (3) pattern of backbone chiral centers; and (4) pattern of backbone P-modification moieties. In some embodiments, provided oligonucleotide compositions contain oligonucleotides that are prepared in a single synthesis process. In some embodiments, provided compositions contain oligonucleotides having more than one chiral configuration within a single oligonucleotide molecule (e.g., where different residues along the oligonucleotide have different stereochemistry); in some such embodiments, such oligonucleotides may be obtained in a single synthesis process, without the need for secondary conjugation steps to generate individual oligonucleotide molecules with more than one chiral configuration.

Oligonucleotide compositions as provided herein can be used as agents for modulating a number of cellular processes and machineries, including but not limited to, transcription, translation, immune responses, epigenetics, etc. In addition, oligonucleotide compositions as provided herein can be used as reagents for research and/or diagnostic purposes. One of ordinary skill in the art will readily recognize that the present disclosure herein is not limited to particular use but is applicable to any situations where the use of synthetic oligonucleotides is desirable. Among other things, provided compositions are useful in a variety of therapeutic, diagnostic, agricultural, and/or research applications.

In some embodiments, provided oligonucleotide compositions comprise oligonucleotides and/or residues thereof that include one or more structural modifications as described in detail herein. In some embodiments, provided oligonucleotide compositions comprise oligonucleoties that contain one or more nucleic acid analogs. In some embodiments, provided oligonucleotide compositions comprise oligonucleotides that contain one or more artificial nucleic acids or residues, including but not limited to: peptide nucleic acids (PNA), Morpholino and locked nucleic acids (LNA), glycon nucleic acids (GNA), threose nucleic acids (TNA), Xeno nucleic acids (XNA), and any combination thereof.

In any of the embodiments, the disclosure is useful for oligonucleotide-based modulation of gene expression, immune response, etc. Accordingly, stereo-defined, oligonucleotide compositions of the disclosure, which contain oligonucleotides of predetermined type (i.e., which are chirally controlled, and optionally chirally pure), can be used in lieu of conventional stereo-random or chirally impure counterparts. In some embodiments, provided compositions show enhanced intended effects and/or reduced unwanted side effects. Certain embodiments of biological and clinical/therapeutic applications of the disclosure are discussed explicitly below.

Various dosing regimens can be utilized to administer .provided chirally controlled oligonucleotide compositions. In some embodiments, multiple unit doses are administered, separated by periods of time. In some embodiments, a given composition has a recommended dosing regimen, which may involve one or more doses. In some embodiments, a dosing regimen comprises a plurality of doses each of which are separated from one another by a time period of the same length; in some embodiments, a dosing regimen comprises a plurality of doses and at least two different time periods separating individual doses. In some embodiments, all doses within a dosing regimen are of the same unit dose amount. In some embodiments, different doses within a dosing regimen are of different amounts. In some embodiments, a dosing regimen comprises a first dose in a first dose amount, followed by one or more additional doses in a second dose amount different from the first dose amount. In some embodiments, a dosing regimen comprises a first dose in a first dose amount, followed by one or more additional doses in a second (or subsequent) dose amount that is same as or different from the first dose (or another prior dose) amount. In some embodiments, a dosing regimen comprises administering at least one unit dose for at least one day. In some embodiments, a dosing regimen comprises administering more than one dose over a time period of at least one day, and sometimes more than one day. In some embodiments, a dosing regimen comprises administering multiple doses over a time period of at least week. In some embodiments, the time period is at least 2, 3, 4, 5, 6, 7, 8, 9, 10, 11, 12, 13, 14, 15, 16, 17, 18, 19, 20, 21, 22, 23 24, 25, 26, 27, 28, 29, 30, 31, 32, 33, 34, 35, 36, 37, 38, 39, 40 or more (e.g., about 45, 50, 55, 60, 65, 70, 75, 80, 85, 90, 95, 100 or more) weeks. In some embodiments, a dosing regimen comprises administering one dose per week for more than one week. In some embodiments, a dosing regimen comprises administering one dose per week for 2, 3, 4, 5, 6, 7, 8, 9, 10, 11, 12, 13, 14, 15, 16, 17, 18, 19, 20, 21, 22, 23 24, 25, 26, 27, 28, 29, 30, 31, 32, 33, 34, 35, 36, 37, 38, 39, 40 or more (e.g., about 45, 50, 55, 60, 65, 70, 75, 80, 85, 90, 95, 100 or more) weeks. In some embodiments, a dosing regimen comprises administering one dose every two weeks for more than two week period. In some embodiments, a dosing regimen comprises administering one dose every two weeks over a time period of 2, 3, 4, 5, 6, 7, 8, 9, 10, 11, 12, 13, 14, 15, 16, 17, 18, 19, 20, 21, 22, 23 24, 25, 26, 27, 28, 29, 30, 31, 32, 33, 34, 35, 36, 37, 38, 39, 40 or more (e.g., about 45, 50, 55, 60, 65, 70, 75, 80, 85, 90, 95, 100 or more) weeks. In some embodiments, a dosing regimen comprises administering one dose per month for one month. In some embodiments, a dosing regimen comprises administering one dose per month for more than one month. In some embodiments, a dosing regimen comprises administering one dose per month for 2, 3, 4, 5, 6, 7, 8, 9, 10, 11, 12, or more months. In some embodiments, a dosing regimen comprises administering one dose per week for about 10 weeks. In some embodiments, a dosing regimen comprises administering one dose per week for about 20 weeks. In some embodiments, a dosing regimen comprises administering one dose per week for about 30 weeks. In some embodiments, a dosing regimen comprises administering one dose per week for 26 weeks. In some embodiments, a chirally controlled oligonucleotide composition is administered according to a dosing regimen that differs from that utilized for a chirally uncontrolled (e.g., stereorandom) oligonucleotide composition of the same sequence, and/or of a different chirally controlled oligonucleotide composition of the same sequence. In some embodiments, a chirally controlled oligonucleotide composition is administered according to a dosing regimen that is reduced as compared with that of a chirally uncontrolled (e.g., stereorandom) oligonucleotide composition of the same sequence in that it achieves a lower level of total exposure over a given unit of time, involves one or more lower unit doses, and/or includes a smaller number of doses over a given unit of time. In some embodiments, a chirally controlled oligonucleotide composition is administered according to a dosing regimen that extends for a longer period of time than does that of a chirally uncontrolled (e.g., stereorandom) oligonucleotide composition of the same sequence Without wishing to be limited by theory, Applicant notes that in some embodiments, the shorter dosing regimen, and/or longer time periods between doses, may be due to the improved stability, bioavailability, and/or efficacy of a chirally controlled oligonucleotide composition. In some embodiments, a chirally controlled oligonucleotide composition has a longer dosing regimen compared to the corresponding chirally uncontrolled oligonucleotide composition. In some embodiments, a chirally controlled oligonucleotide composition has a shorter time period between at least two doses compared to the corresponding chirally uncontrolled oligonucleotide composition. Without wishing to be limited by theory, Applicant notes that in some embodiments longer dosing regimen, and/or shorter time periods between doses, may be due to the improved safety of a chirally controlled oligonucleotide composition.

In some embodiments, with their low toxicity, provided oligonucleotides and compositions can be administered in higher dosage and/or with higher frequency. In some embodiments, with their improved delivery (and other properties), provided compositions can be administered in lower dosages and/or with lower frequency to achieve biological effects, for example, clinical efficacy.

A single dose can contain various amounts of oligonucleotides. In some embodiments, a single dose can contain various amounts of a type of chirally controlled oligonucleotide, as desired suitable by the application. In some embodiments, a single dose contains about 1, 5, 10, 20, 30, 40, 50, 60, 70, 80, 90, 100, 110, 120, 130, 140, 150, 160, 170, 180, 190, 200, 210, 220, 230, 240, 250, 260, 270, 280, 290, 300 or more (e.g., about 350, 400, 450, 500, 550, 600, 650, 700, 750, 800, 850, 900, 950, 1000 or more) mg of a type of chirally controlled oligonucleotide. In some embodiments, a single dose contains about 1 mg of a type of chirally controlled oligonucleotide. In some embodiments, a single dose contains about 5 mg of a type of chirally controlled oligonucleotide. In some embodiments, a single dose contains about 10 mg of a type of chirally controlled oligonucleotide. In some embodiments, a single dose contains about 15 mg of a type of chirally controlled oligonucleotide. In some embodiments, a single dose contains about 20 mg of a type of chirally controlled oligonucleotide. In some embodiments, a single dose contains about 50 mg of a type of chirally controlled oligonucleotide. In some embodiments, a single dose contains about 100 mg of a type of chirally controlled oligonucleotide. In some embodiments, a single dose contains about 150 mg of a type of chirally controlled oligonucleotide. In some embodiments, a single dose contains about 200 mg of a type of chirally controlled oligonucleotide. In some embodiments, a single dose contains about 250 mg of a type of chirally controlled oligonucleotide. In some embodiments, a single dose contains about 300 mg of a type of chirally controlled oligonucleotide. In some embodiments, a chirally controlled oligonucleotide is administered at a lower amount in a single dose, and/or in total dose, than a chirally uncontrolled oligonucleotide. In some embodiments, a chirally controlled oligonucleotide is administered at a lower amount in a single dose, and/or in total dose, than a chirally uncontrolled oligonucleotide due to improved efficacy. In some embodiments, a chirally controlled oligonucleotide is administered at a higher amount in a single dose, and/or in total dose, than a chirally uncontrolled oligonucleotide. In some embodiments, a chirally controlled oligonucleotide is administered at a higher amount in a single dose, and/or in total dose, than a chirally uncontrolled oligonucleotide due to improved safety.

Biologically Active Oligonucleotides

A provided oligonucleotide composition as used herein may comprise single stranded and/or multiply stranded oligonucleotides. In some embodiments, single-stranded oligonucleotides contain self-complementary portions that may hybridize under relevant conditions so that, as used, even single-stranded oligonucleotides may have at least partially double-stranded character. In some embodiments, an oligonucleotide included in a provided composition is single-stranded, double-stranded, or triple-stranded. In some embodiments, an oligonucleotide included in a provided composition comprises a single-stranded portion and a multiple-stranded portion within the oligonucleotide. In some embodiments, as noted above, individual single-stranded oligonucleotides can have double-stranded regions and single-stranded regions.

In some embodiments, provided compositions include one or more oligonucleotides fully or partially complementary to strand of: structural genes, genes control and/or termination regions, and/or self-replicating systems such as viral or plasmid DNA. In some embodiments, provided compositions include one or more oligonucleotides that are or act as siRNAs or other RNA interference reagents (RNAi agents or iRNA agents), shRNA, antisense oligonucleotides, self-cleaving RNAs, ribozymes, fragment thereof and/or variants thereof (such as Peptidyl transferase 23S rRNA, RNase P, Group I and Group II introns, GIR1 branching ribozymes, Leadzyme, Hairpin ribozymes, Hammerhead ribozymes, HDV ribozymes, Mammalian CPEB3 ribozyme, VS ribozymes, glmS ribozymes, CoTC ribozyme, etc.), microRNAs, microRNA mimics, supermirs, aptamers, antimirs, antagomirs, UI adaptors, triplex-forming oligonucleotides, RNA activators, long non-coding RNAs, short non-coding RNAs (e.g., piRNAs), immunomodulatory oligonucleotides (such as immunostimulatory oligonucleotides, immunoinhibitory oligonucleotides), GNA, LNA, ENA, PNA, TNA, morpholinos, G-quadruplex (RNA and DNA), antiviral oligonucleotides, and decoy oligonucleotides.

In some embodiments, provided compositions include one or more hybrid (e.g., chimeric) oligonucleotides. In the context of the present disclosure, the term "hybrid" broadly refers to mixed structural components of oligonucleotides. Hybrid oligonucleotides may refer to, for example, (1) an oligonucleotide molecule having mixed classes of nucleotides, e.g., part DNA and part RNA within the single molecule (e.g., DNA-RNA); (2) complementary pairs of nucleic acids of different classes, such that DNA:RNA base pairing occurs either intramolecularly or intermolecularly; or both; (3) an oligonucleotide with two or more kinds of the backbone or internucleotide linkages.

In some embodiments, provided compositions include one or more oligonucleotide that comprises more than one classes of nucleic acid residues within a single molecule. For example, in any of the embodiments described herein, an oligonucleotide may comprise a DNA portion and an RNA portion. In some embodiments, an oligonucleotide may comprise a unmodified portion and modified portion.

Provided oligonucleotide compositions can include oligonucleotides containing any of a variety of modifications, for example as described herein. In some embodiments, particular modifications are selected, for example, in light of intended use. In some embodiments, it is desirable to modify one or both strands of a double-stranded oligonucleotide (or a double-stranded portion of a single-stranded oligonucleoties). In some embodiments, the two strands (or portions) include different modifications. In some embodiments, the two strands include the same modifications. One of skill in the art will appreciate that the degree and type of modifications enabled by methods of the present disclosure allow for numerous permutations of modifications to be made. Examples of such modifications are described herein and are not meant to be limiting.

The phrase "antisense strand" as used herein, refers to an oligonucleotide that is substantially or 100% complementary to a target sequence of interest. The phrase "antisense strand" includes the antisense region of both oligonucleotides that are formed from two separate strands, as well as unimolecular oligonucleotides that are capable of forming hairpin or dumbbell type structures. The terms "antisense strand" and "guide strand" are used interchangeably herein.

The phrase "sense strand" refers to an oligonucleotide that has the same nucleoside sequence, in whole or in part, as a target sequence such as a messenger RNA or a sequence of DNA. The terms "sense strand" and "passenger strand" are used interchangeably herein.

By "target sequence" is meant any nucleic acid sequence whose expression or activity is to be modulated. The target nucleic acid can be DNA or RNA, such as endogenous DNA or RNA, viral DNA or viral RNA, or other RNA encoded by a gene, virus, bacteria, fungus, mammal, or plant. In some embodiments, a target sequence is associated with a disease or disorder. As illustrated in the present disclosure, in some embodiments, a target sequence is or comprises a portion of the DMD gene; in some embodiments, a target sequence is or comprises a portion of the DMD pre-mRNA; in some embodiments, a target sequence is or comprises a portion of the DMD mRNA; in some embodiments, a target sequence is a portion of the DMD gene; in some embodiments, a target sequence is a portion of the DMD pre-mRNA; and in some embodiments, a target sequence is a portion of the DMD mRNA. In some embodiments, provided oligonucleotides hybridize with a target sequence.

By "specifically hybridizable" and "complementary" is meant that a nucleic acid can form hydrogen bond(s) with another nucleic acid sequence by either traditional Watson-Crick or other non-traditional types. In reference to the nucleic molecules of the present disclosure, the binding free energy for a nucleic acid molecule with its complementary sequence is sufficient to allow the relevant function of the nucleic acid to proceed, e.g., RNAi activity. Determination of binding free energies for nucleic acid molecules is well known in the art (see, e.g., Turner et al, 1987, *CSH Symp. Quant. Biol. LIT* pp. 123-133; Freier et al., 1986, *Proc. Nat. Acad. Sci. USA* 83:9373-9377; Turner et al., 1987, *J. Am. Chem. Soc.* 109:3783-3785).

A percent complementarity indicates the percentage of contiguous residues in a nucleic acid molecule that can form hydrogen bonds (e.g., Watson-Crick base pairing) with a second nucleic acid sequence (e.g., 5, 6, 7, 8, 9, 10 out of 10 being 50%, 60%, 70%, 80%, 90%, and 100% complementary). "Perfectly complementary" or 100% complementarity means that all the contiguous residues of a nucleic acid sequence will hydrogen bond with the same number of contiguous residues in a second nucleic acid sequence. Less than perfect complementarity refers to the situation in which some, but not all, nucleoside units of two strands can hydrogen bond with each other. "Substantial complementarity" refers to polynucleotide strands exhibiting 90% or greater complementarity, excluding regions of the polynucleotide strands, such as overhangs, that are selected so as to be noncomplementary. Specific binding requires a sufficient degree of complementarity to avoid non-specific binding of the oligomeric compound to non-target sequences under conditions in which specific binding is desired, e.g., under physiological conditions in the case of in vivo assays or therapeutic treatment, or in the case of in vitro assays, under conditions in which the assays are performed. In some embodiments, non-target sequences differ from corresponding target sequences by at least 5 nucleotides.

When used as therapeutics, a provided oligonucleotide is administered as a pharmaceutical composition. In some embodiments, the pharmaceutical composition comprises a therapeutically effective amount of a provided oligonucleotide comprising, or a pharmaceutically acceptable salt thereof, and at least one pharmaceutically acceptable inactive ingredient selected from pharmaceutically acceptable diluents, pharmaceutically acceptable excipients, and pharmaceutically acceptable carriers. In another embodiment, the pharmaceutical composition is formulated for intravenous injection, oral administration, buccal administration, inhalation, nasal administration, topical administration, ophthalmic administration or otic administration. In further embodiments, the pharmaceutical composition is a tablet, a pill, a capsule, a liquid, an inhalant, a nasal spray solution, a suppository, a suspension, a gel, a colloid, a dispersion, a suspension, a solution, an emulsion, an ointment, a lotion, an eye drop or an ear drop.

Pharmaceutical Compositions

When used as therapeutics, a provided oligonucleotide or oligonucleotide composition described herein is administered as a pharmaceutical composition. In some embodiments, the pharmaceutical composition comprises a therapeutically effective amount of a provided oligonucleotides, or a pharmaceutically acceptable salt thereof, and at least one pharmaceutically acceptable inactive ingredient selected from pharmaceutically acceptable diluents, pharmaceutically acceptable excipients, and pharmaceutically acceptable carriers. In some embodiments, in provided compositions provided oligonucleotides may exist as salts, preferably pharmaceutically acceptable salts, e.g., sodium salts, ammonium salts, etc. In some embodiments, a salt of a provided oligonucleotide comprises two or more cations, for example, in some embodiments, up to the number of negatively charged acidic groups (e.g., phosphate, phosphorothioate, etc.) in an oligonucleotide. In some embodiments, the pharmaceutical composition is formulated for intravenous injection, oral administration, buccal administration, inhalation, nasal administration, topical administration, ophthalmic administration or otic administration. In some embodiments, the pharmaceutical composition is a tablet, a pill, a capsule, a liquid, an inhalant, a nasal spray solution, a suppository, a suspension, a gel, a colloid, a dispersion, a suspension, a solution, an emulsion, an ointment, a lotion, an eye drop or an ear drop.

In some embodiments, the present disclosure provides a pharmaceutical composition comprising chirally controlled oligonucleotide, or composition thereof, in admixture with a pharmaceutically acceptable excipient. One of skill in the art will recognize that the pharmaceutical compositions include the pharmaceutically acceptable salts of the chirally controlled oligonucleotide, or composition thereof, described above.

In some embodiments, the present disclosure provides technologies (e.g., compositions, methods, etc.) for combination therapy, for example, with other therapeutic agents and/or medical procedures. In some embodiments, provided oligonucleotides and/or compositions may be used together with one or more other therapeutic agents. In some embodiments, provided compositions comprise provided oligonucleotides, and one or more other therapeutic agents. In some embodiments, the one or more other therapeutic agents may have one or more different targets, and/or one or more different mechanisms toward targets, when compared to provided oligonucleotides in the composition. In some embodiments, a therapeutic agent is an oligonucleotide. In some embodiments, a therapeutic agent is a small molecule drug. In some embodiments, a therapeutic agent is a protein. In some embodiments, a therapeutic agent is an antibody. A number of a therapeutic agent may be utilized in accordance with the present disclosure. For example, oligonucleotides for DMD may be used together with one or more a therapeutic agents that modulate utrophin production (utrophin modulators). In some embodiments, a utrophin modulator promotes production of utrophin. In some embodiments, a utrophin modulator is ezutromid. In some embodiments, a utrophin modulator is

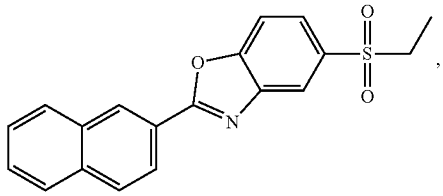 [SMILES: CCS(=O)(=O)c1ccc2oc(-c3ccc4ccccc4c3)nc2c1]
, or a pharmaceutically acceptable salt thereof. In some embodiments, provided oligonucleotides or compositions thereof are administered prior to, concurrently with, or subsequent to one or more other therapeutic agents and/or medical procedures. In some embodiments, provided oligonucleotides or compositions thereof are administered concurrently with one or more other therapeutic agents and/or medical procedures. In some embodiments, provided oligonucleotides or compositions thereof are administered prior to one or more other therapeutic agents and/or medical procedures. In some embodiments, provided oligonucleotides or compositions thereof are administered subsequent to one or more other therapeutic agents and/or medical procedures. In some embodiments, provide compositions comprise one or more other therapeutic agents.

A variety of supramolecular nanocarriers can be used to deliver nucleic acids. Example nanocarriers include, but are not limited to liposomes, cationic polymer complexes and various polymeric. Complexation of nucleic acids with various polycations is another approach for intracellular delivery; this includes use of PEGlyated polycations, polyethyleneamine (PEI) complexes, cationic block co-polymers, and dendrimers. Several cationic nanocarriers, including PEI and polyamidoamine dendrimers help to release contents from endosomes. Other approaches include use of polymeric nanoparticles, polymer micelles, quantum dots and lipoplexes. In some embodiments, an oligonucleotide is conjugated to another molecular.

Additional nucleic acid delivery strategies are known in addition to the example delivery strategies described herein.

In therapeutic and/or diagnostic applications, the compounds of the disclosure can be formulated for a variety of modes of administration, including systemic and topical or localized administration. Techniques and formulations generally may be found in Remington, The Science and Practice of Pharmacy, (20th ed. 2000).

Provided oligonucleotides, and compositions thereof, are effective over a wide dosage range. For example, in the treatment of adult humans, dosages from about 0.01 to about 1000 mg, from about 0.5 to about 100 mg, from about 1 to about 50 mg per day, and from about 5 to about 100 mg per day are examples of dosages that may be used. The exact dosage will depend upon the route of administration, the form in which the compound is administered, the subject to be treated, the body weight of the subject to be treated, and the preference and experience of the attending physician.

Pharmaceutically acceptable salts are generally well known to those of ordinary skill in the art, and may include, by way of example but not limitation, acetate, benzenesulfonate, besylate, benzoate, bicarbonate, bitartrate, bromide, calcium edetate, carnsylate, carbonate, citrate, edetate, edisylate, estolate, esylate, fumarate, gluceptate, gluconate, glutamate, glycollylarsanilate, hexylresorcinate, hydrabamine, hydrobromide, hydrochloride, hydroxynaphthoate, iodide, isethionate, lactate, lactobionate, malate, maleate, mandelate, mesylate, mucate, napsylate, nitrate, pamoate (embonate), pantothenate, phosphate/diphosphate, polygalacturonate, salicylate, stearate, subacetate, succinate, sulfate, tannate, tartrate, or teoclate. Other pharmaceutically acceptable salts may be found in, for example, Remington, The Science and Practice of Pharmacy (20th ed. 2000). Preferred pharmaceutically acceptable salts include, for example, acetate, benzoate, bromide, carbonate, citrate, gluconate, hydrobromide, hydrochloride, maleate, mesylate, napsylate, pamoate (embonate), phosphate, salicylate, succinate, sulfate, or tartrate.

As appreciated by a person having ordinary skill in the art, oligonucleotides may be formulated as a number of salts for, e.g., pharmaceutical uses. In some embodiments, a salt is a metal cation salt and/or ammonium salt. In some embodiments, a salt is a metal cation salt of an oligonucleotide. In some embodiments, a salt is an ammonium salt of an oligonucleotide. Representative alkali or alkaline earth metal salts include sodium, lithium, potassium, calcium, magnesium, and the like. In some embodiments, a salt is a sodium salt of an oligonucleotide. In some embodiments, pharmaceutically acceptable salts include, when appropriate, nontoxic ammonium, quaternary ammonium, and amine cations formed with counterions such as hydroxide, carboxylate, sulfate, phosphate, nitrate, sulfonate, phosphorothioate, etc. that may be within provided oligonucleotides. As appreciated by a person having ordinary skill in the art, a salt of an oligonucleotide may contain more than one cations, e.g., sodium ions, as there may be more than one anions within an oligonucleotide.

Depending on the specific conditions being treated, such agents may be formulated into liquid or solid dosage forms and administered systemically or locally. The agents may be delivered, for example, in a timed- or sustained-low release form as is known to those skilled in the art. Techniques for formulation and administration may be found in Remington, The Science and Practice of Pharmacy (20th ed. 2000). Suitable routes may include oral, buccal, by inhalation spray, sublingual, rectal, transdermal, vaginal, transmucosal, nasal or intestinal administration; parenteral delivery, including intramuscular, subcutaneous, intramedullary injections, as well as intrathecal, direct intraventricular, intravenous, intra-articular, intra-sternal, intra-synovial, intra-hepatic, intralesional, intracranial, intraperitoneal, intranasal, or intraocular injections or other modes of delivery.

For injection, the agents of the disclosure may be formulated and diluted in aqueous solutions, such as in physiologically compatible buffers such as Hank's solution, Ringer's solution, or physiological saline buffer. For such transmucosal administration, penetrants appropriate to the barrier to be permeated are used in the formulation. Such penetrants are generally known in the art.

Use of pharmaceutically acceptable inert carriers to formulate the compounds herein disclosed for the practice of the disclosure into dosages suitable for systemic administration is within the scope of the disclosure. With proper choice of carrier and suitable manufacturing practice, the compositions of the present disclosure, in particular, those formulated as solutions, may be administered parenterally, such as by intravenous injection.

The compounds can be formulated readily using pharmaceutically acceptable carriers well known in the art into dosages suitable for oral administration. Such carriers enable the compounds of the disclosure to be formulated as tablets, pills, capsules, liquids, gels, syrups, slurries, suspensions and the like, for oral ingestion by a subject (e.g., patient) to be treated.

For nasal or inhalation delivery, the agents of the disclosure may also be formulated by methods known to those of skill in the art, and may include, for example, but not limited to, examples of solubilizing, diluting, or dispersing substances such as, saline, preservatives, such as benzyl alcohol, absorption promoters, and fluorocarbons.

In certain embodiments, oligonucleotides and compositions are delivered to the CNS. In certain embodiments, oligonucleotides and compositions are delivered to the cerebrospinal fluid. In certain embodiments, oligonucleotides and compositions are administered to the brain parenchyma. In certain embodiments, oligonucleotides and compositions are delivered to an animal/subject by intrathecal administration, or intracerebroventricular administration. Broad distribution of oligonucleotides and compositions, described herein, within the central nervous system may be achieved with intraparenchymal administration, intrathecal administration, or intracerebroventricular administration.

In certain embodiments, parenteral administration is by injection, by, e.g., a syringe, a pump, etc. In certain embodiments, the injection is a bolus injection. In certain embodiments, the injection is administered directly to a tissue, such as striatum, caudate, cortex, hippocampus and cerebellum.

In certain embodiments, methods of specifically localizing a pharmaceutical agent, such as by bolus injection, decreases median effective concentration (EC50) by a factor of 20, 25, 30, 35, 40, 45 or 50. In certain embodiments, the pharmaceutical agent in an antisense compound as further described herein. In certain embodiments, the targeted tissue is brain tissue. In certain embodiments the targeted tissue is striatal tissue. In certain embodiments, decreasing EC50 is desirable because it reduces the dose required to achieve a pharmacological result in a patient in need thereof.

In certain embodiments, an antisense oligonucleotide is delivered by injection or infusion once every month, every two months, every 90 days, every 3 months, every 6 months, twice a year or once a year.

Pharmaceutical compositions suitable for use in the present disclosure include compositions wherein the active ingredients are contained in an effective amount to achieve its intended purpose. Determination of the effective amounts is well within the capability of those skilled in the art, especially in light of the detailed disclosure provided herein.

In addition to the active ingredients, these pharmaceutical compositions may contain suitable pharmaceutically acceptable carriers comprising excipients and auxiliaries which facilitate processing of an active compound into preparations which can be used pharmaceutically. The preparations formulated for oral administration may be in the form of tablets, dragees, capsules, or solutions.

Pharmaceutical preparations for oral use can be obtained by combining an active compound with solid excipients, optionally grinding a resulting mixture, and processing the mixture of granules, after adding suitable auxiliaries, if desired, to obtain tablets or dragee cores. Suitable excipients are, in particular, fillers such as sugars, including lactose, sucrose, mannitol, or sorbitol; cellulose preparations, for example, maize starch, wheat starch, rice starch, potato starch, gelatin, gum tragacanth, methyl cellulose, hydroxypropylmethyl-cellulose, sodium carboxymethyl-cellulose (CMC), and/or polyvinylpyrrolidone (PVP: povidone). If desired, disintegrating agents may be added, such as the cross-linked polyvinylpyrrolidone, agar, or alginic acid or a salt thereof such as sodium alginate.

Dragee cores are provided with suitable coatings. For this purpose, concentrated sugar solutions may be used, which may optionally contain gum arabic, talc, polyvinylpyrrolidone, carbopol gel, polyethylene glycol (PEG), and/or titanium dioxide, lacquer solutions, and suitable organic solvents or solvent mixtures. Dye-stuffs or pigments may be added to the tablets or dragee coatings for identification or to characterize different combinations of active compound doses.

Pharmaceutical preparations that can be used orally include push-fit capsules made of gelatin, as well as soft, sealed capsules made of gelatin, and a plasticizer, such as glycerol or sorbitol. The push-fit capsules can contain the active ingredients in admixture with filler such as lactose, binders such as starches, and/or lubricants such as talc or magnesium stearate and, optionally, stabilizers. In soft capsules, an active compound may be dissolved or suspended in suitable liquids, such as fatty oils, liquid paraffin, or liquid polyethylene glycols (PEGs). In addition, stabilizers may be added.

A composition can be obtained by combining an active compound with a lipid. In some embodiments, the lipid is conjugated to an active compound. In some embodiments, the lipid is not conjugated to an active compound. In some embodiments, a lipid comprises a $C_{10}$-$C_{40}$ linear, saturated or partially unsaturated, aliphatic chain. In some embodiments, a lipid comprises a $C_{10}$-$C_{40}$ linear, saturated or partially unsaturated, aliphatic chain, optionally substituted with one or more $C_{1-4}$ aliphatic group. In various embodiments, the lipid is selected from the group consisting of: lauric acid, myristic acid, palmitic acid, stearic acid, oleic acid, linoleic acid, alpha-linolenic acid, gamma-linolenic acid, docosahexaenoic acid (cis-DHA), turbinaric acid and dilinoleyl. In some embodiments, a lipid has a structure of any of:

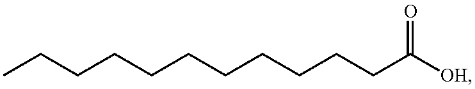

Lauric acid

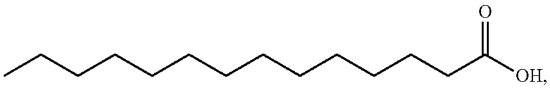

Myristic Acid

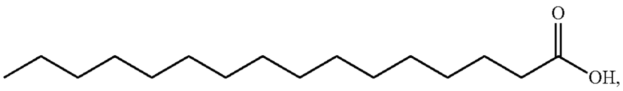

Palmitic Acid

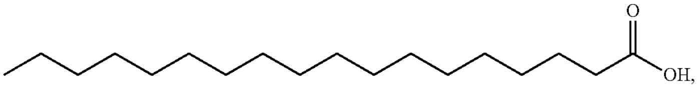

Stearic Acid

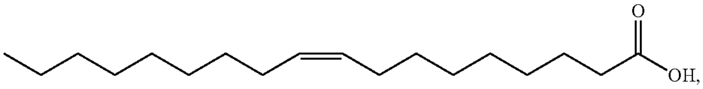

Oleic Acid

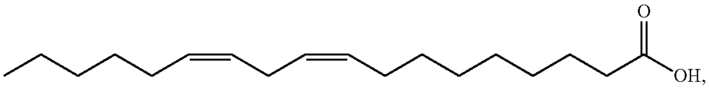

Linoleic Acid

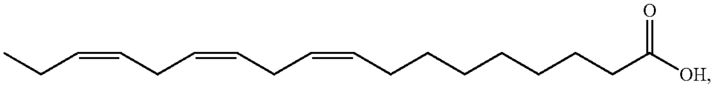

Alpha Linoleic Acid

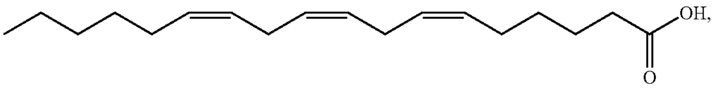

Gamma Linoleic Acid

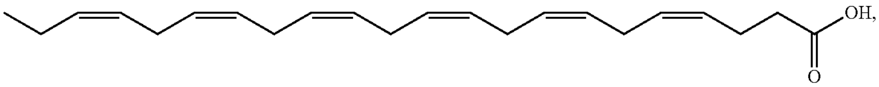

Docosahexaenoic acid

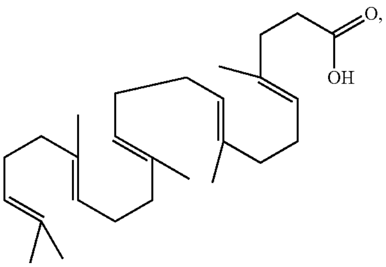

Turbinaric acid

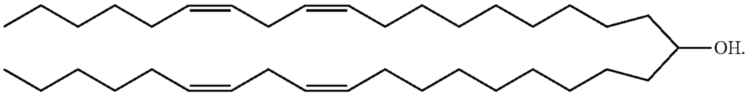

Dilinoleyl alcohol

In various embodiments, an active compound is any oligonucleotide or other nucleic acid described herein. In various embodiments, an active compound is an oligonucleotide capable of mediating skipping of an exon in dystrophin. In various embodiments, an active compound is an oligonucleotide capable of mediating skipping of exon 51 in dystrophin. In various embodiments, an active compound is a nucleic acid of a sequence comprising or consisting of any sequence of any nucleic acid listed in Tables 2-4. In various embodiments, an active compound is a nucleic acid of a sequence comprising or consisting of any sequence of any nucleic acid listed in Table 2. In various embodiments, an active compound is a nucleic acid of a sequence comprising or consisting of any sequence of any nucleic acid listed in Table 3. In various embodiments, an active compound is a nucleic acid of a sequence comprising or consisting of any sequence of any nucleic acid listed in Table 4. In various embodiments, a composition comprises a lipid and an active compound, and further comprises another component selected from: another lipid, and a targeting compound or moiety. In some embodiments, a lipid includes, without limitation: an amino lipid; an amphipathic lipid; an anionic lipid; an apolipoprotein; a cationic lipid; a low molecular weight cationic lipid; a cationic lipid such as CLinDMA and DLinDMA; an ionizable cationic lipid; a cloaking component; a helper lipid; a lipopeptide; a neutral lipid; a neutral zwitterionic lipid; a hydrophobic small molecule; a hydrophobic vitamin; a PEG-lipid; an uncharged lipid modified with one or more hydrophilic polymers; phospholipid; a phospholipid such as 1,2-dioleoyl-sn-glycero-3-phosphoethanolamine; a stealth lipid; a sterol; a cholesterol; and a targeting lipid; and any other lipid described herein or reported in the art. In some embodiments, a composition comprises a lipid and a portion of another lipid capable of mediating at least one function of another lipid. In some embodiments, a targeting compound or moiety is capable of targeting a compound (e.g., a composition comprising a lipid and a active compound) to a particular cell or tissue or subset of cells or tissues. In some embodiments, a targeting moiety is designed to take advantage of cell- or tissue-specific expression of particular targets, receptors, proteins, or other subcellular components; In some embodiments, a targeting moiety is a ligand (e.g., a small molecule, antibody, peptide, protein, carbohydrate, aptamer, etc.) that targets a composition to a cell or tissue, and/or binds to a target, receptor, protein, or other subcellular component.

As shown in FIG. 20, certain example lipids for use in preparation of a composition for delivery of an active compound allow (e.g., do not prevent or interfere with) the function of an active compound. Non-limiting example lipids include: lauric acid, myristic acid, palmitic acid, stearic acid, oleic acid, linoleic acid, alpha-linolenic acid, gamma-linolenic acid, docosahexaenoic acid (cis-DHA), turbinaric acid and dilinoleyl.

An active compound, oligonucleotide WV-942, was tested for its biological activity in human DMD (Duchenne muscular dystrophy) myoblasts. In the absence of exon 51 skipping, the protein is severely truncated due to a frameshift mutation, leading to a premature stop codon. Oligonucleotide WV-942, which has a sequence and chemical identical to Drisapersen, also known as Kyndrisa, PRO051 and GSK2402968, is intended to allow skipping of exon 51, thus allowing production of a frame-corrected dystrophin transcript which lacks exon 51. As demonstrated in the present disclosure, provided oligonucleotides can provide surprisingly higher skipping efficiency when compared to WV-942.

As described in the present disclosure, lipid conjugation, such as conjugation with fatty acids, may improve one or more properties of oligonucleotides. In an example experiment, myoblast cells were treated with naked WV-942 (not conjugated to any lipid), or WV-942 conjugated to any one of several lipids: lauric acid, myristic acid, palmitic acid, stearic acid, oleic acid, linoleic acid, alpha-linolenic acid, gamma-linolenic acid, docosahexaenoic acid (cis-DHA), turbinaric acid and dilinoleyl (listed below in Table 5).

TABLE 5

Lipids conjugated to active compound, oligonucleotide WV-942.

| Oligonucleotide | Conjugated Acid |
|---|---|
| WV-942 | — |
| WV-2578 | Lauric acid |
| WV-2579 | Myristic Acid |
| WV-2580 | Palmitic acid |
| WV-2581 | Stearic acid |
| WV-2582 | Oleic acid |
| WV-2583 | Linoleic acid |
| WV-2584 | Alpha-Linolenic acid |
| WV-2585 | Gamma-Linolenic acid |
| WV-2586 | cis-DHA |
| WV-2587 | Turbinaric acid |
| WV-2588 | Dilinoleyl |

In some embodiments, example results demonstrated that preparing a composition comprising an active compound, WV-942, and any of several lipids (lauric acid, myristic acid, palmitic acid, stearic acid, oleic acid, linoleic acid, alpha-linolenic acid, gamma-linolenic acid, docosahexaenoic acid (cis-DHA), turbinaric acid and dilinoleyl) did not prevent biological activity of the agent; in fact, in several cases, in the addition of a lipid, biological activity was increased several-fold.

FIGS. 29 and 37 include additional example data showing that conjugation with lipids can increase skipping efficiency. FIG. 29 shows that increased skipping efficiencies where achieved when stereopure oligonucleotide WV-3473 is conjugated to stearic acid (to make WV-3545) or turbinaric acid (to make WV-3546). WV-3473 is 5'-fU*SfC*SfA*SfA*SfG*SfG*SmAfA*SmGmA*SfU*SmGmGfC*SfA*SfU*SfU*SfU*SfC*Sf U-3' (SEQ ID NO: 820), wherein *S is a phosphorothioate linkage in Sp configuration, f is 2'-F, and m is 2'-OMe, with a phosphodiester linkage where no internucleotidic linkage is indicated; WV-3545 is 5'-Mod015L001fU*SfC*SfA*SfA*SfG*SfG*SmAfA*SmGmA*SfU*SmGmGfC*SfA*SfU*SfJ*SfU*SfC*SfJ-3' (SEQ ID NO: 838), which is identical to WV-3473, except that Mod015L001 indicates stearic acid with $C_6$ PO linker; WV-3546 is 5'-Mod020L001fU*SfC*SfA*SfA*SfG*SfG*SmAfA*SmGmA*SfJ*SmGmGfC*SfA*SfU*SfU*SfU*SfC*SfJ-3' (SEQ ID NO: 839), which is identical to WV-3473, except that Mod020L001 represents turbinaric acid with $C_6$ PO linker. FIG. 37 shows that conjugation with a lipid increases the skipping efficiency of WV-942 (Drisapersen). WV-2578 to WV-2587 represent WV-942 conjugated to various lipids (here, fatty acids): Lauric acid, Myristic acid, Palmitic acid, Stearic acid, Oleic acid, Linoleic acid, alpha-Linolenic acid, gamma-Linolenic acid, DHA acid, and Turbinaric acid, respectively.

In some embodiments, a composition for delivery of an active compound is capable of targeting an active compound to particular cells or tissues, as desired. In some embodiments, a composition for delivery of an active compound is capable of targeting an active compound to a muscle cell or tissue. In some embodiments, the present disclosure pertains to compositions and methods related to delivery of active compounds, wherein the compositions comprise an active compound a lipid. In various embodiments to a muscle cell or tissue, the lipid is selected from: lauric acid, myristic acid, palmitic acid, stearic acid, oleic acid, linoleic acid, alpha-linolenic acid, gamma-linolenic acid, docosahexaenoic acid (cis-DHA), turbinaric acid and dilinoleyl. As shown in FIGS. 19 to 23, example compositions were prepared comprising an active compound (WV-942) and a lipid, and these compositions were capable of delivering an active compound to target cells and tissues, e.g., muscle cells and tissues. The example lipids used include stearic acid, oleic acid, alpha-linolenic acid, gamma-linolenic acids, cis-DHA, turbinaric acid and dilinoleyl acid. In these figures, "TBD" indicates that the particular composition was effective for delivery, but the numerical results were outside the standard range, and thus the final results remain to be determined; however, the compositions indicated as "TBD" in the Figures were efficacious at delivery of an active compound.

As shown in FIG. 19: A composition comprising an active compound and any of: stearic acid, oleic acid, alpha-linolenic acid, gamma-linolenic acid, cis-DHA or turbinaric acid, was able to deliver an active compound to gastrocnemius muscle tissue. A composition comprising an active compound and any of: stearic acid, alpha-linolenic, gamma-linolenic, cis-DHA, or turbinaric acid, was able to deliver an active compound to heart muscle tissue. A composition comprising an active compound and any of: stearic acid, oleic acid, alpha-linolenic acid, gamma-linolenic acid, cis-DHA or turbinaric acid, was able to deliver an active compound to quadriceps muscle tissue. As shown in FIG. 20: A composition comprising an active compound and any of: stearic, oleic, alpha-linolenic, gamma-linolenic, cis-DHA, or turbinaric acid was able to deliver an active compound to the gastrocnemius muscle tissue. A composition comprising an active compound and any of: stearic acid, alpha-linolenic, gamma-linolenic, cis-DHA, or turbinaric acid was able to deliver an active compound to heart muscle tissue. A composition comprising an active compound and any of: dilinoleyl, stearic acid, oleic acid, alpha-linolenic, gamma-linolenic, cis-DHA or turbinaric acid was able to delivery an active compound to the diaphragm muscle tissue.

Thus: A composition comprising a lipid, selected from: lauric acid, myristic acid, palmitic acid, stearic acid, oleic acid, linoleic acid, alpha-linolenic acid, gamma-linolenic acid, docosahexaenoic acid (cis-DHA), turbinaric acid and dilinoleyl, and an active compound is capable of delivering an active compound to extra-hepatic cells and tissues, e.g., muscle cells and tissues.

Depending upon the particular condition, or disease state, to be treated or prevented, additional therapeutic agents, which are normally administered to treat or prevent that condition, may be administered together with oligonucleotides of this disclosure. For example, chemotherapeutic agents or other anti-proliferative agents may be combined with the oligonucleotides of this disclosure to treat proliferative diseases and cancer. Examples of known chemotherapeutic agents include, but are not limited to, adriamycin, dexamethasone, vincristine, cyclophosphamide, fluorouracil, topotecan, taxol, interferons, and platinum derivatives.

Lipids

In some embodiments, provided oligonucleotide compositions further comprise one or more lipids. In some embodiments, conjugation of provided oligonucleotides with lipids can mediate unexpected, greatly improved properties (e.g., activities, toxicities, distribution, pharmacokinetics, etc.). In some embodiments, provided oligonucleotides have the structure of $A^c$-[-$L^{LD}$-$(R^{LD})_a]_b$. In some embodiments, provided oligonucleotides have the structure of $[(A^c)_aL^{LD}]_b$-$R^{LD}$. In some embodiments, $L^{LD}$, $R^{LD}$, combinations of $L^{LD}$ and $R^{LD}$, or -[-$L^{LD}$-$(R^{LD})_a]_b$ comprises one or more lipid moieties In some embodiments, provided oligonucleotides do not mediate an immune response. In some embodiments, provided oligonucleotides do not have hTLR9 agonist activities, for example, under conditions of FIG. 30. In some embodiments, provided oligonucleotides have hTLR9 antagonist activities. In some embodiments, provided oligonucleotides counteract hTLR9 agonist activities, for example, under conditions of FIG. 31. In some embodiments, the present disclosure provides oligonucleotides conjugated to lipids which conjugates demonstrate hTLR9 unexpectedly higher antagonist activities when compared to the same unconjugated oligonucleotides. For example, oligonucleotides WV-3545 and WV-3546, which comprise WV-3473 conjugated to stearic acid (WV-3545) or turbinaric acid (WV-3473) demonstrated surprisingly high activities to antagonize the hTLR9 agonistic activity of ODN2006, to a much higher degree than unconjugated WV-3473. See, for example, FIGS. 30 to 32.

In some embodiments, conjugation of a lipid to a provided oligonucleotide improves distribution and/or pharmacokinetics. In some embodiments, conjugation of a lipid to a provided oligonucleotide improves one or more measurement of pharmacokinetics selected from: $C_{max}$, peak plasma concentration of a drug after administration; $t_{max}$, time to reach $C_{max}$; $C_{min}$, lowest (trough) concentration that a drug reaches before the next dose is administered; elimination half-life, the time required for the concentration of the drug to reach half of its original value; elimination rate constant, rate at which a drug is removed from the body; area under the curve, integral of the concentration-time curve (after a single dose or in steady state); and clearance, volume of plasma cleared of the drug per unit time. Without being bound to any particular theory, this disclosure notes that optimization of a pharmacokinetic characteristic such as half-life can be distinguished from maximization. In some embodiments, in general, it may be desirable for a particular drug to have a half-life sufficient to allow performance of its desired function, but short enough to minimize off-target effects and other toxicity. In some embodiments, an optimized half-life is long enough to allow activity while minimizing toxicity; a prolonged or maximized half-life may be undesirable. Among other things, the present disclosure shows that conjugation with a lipid can improve the half-life of a biologically active agent. FIGS. 38A to 38D show the distribution of oligonucleotides (including some conjugated to a lipid) in various muscle tissues. Muscles tested include: gastrocnemius (FIG. 38A); triceps (FIG. 38B); heart (FIG. 38C); and diaphragm (FIG. 38D). Control oligonucleotide WV-942 is equivalent to Drisapersen, which has an undesirably long half-life, which can contribute to toxicity. Test oligonucleotide WV-3473 was administered to animals naked, or conjugated to a lipid (stearic acid, WV-3545; or turbinaric acid, WV-3546). In some of the assays, conjugation to a lipid improved half-life of the oligonucleotide, without extending it to an undesirably long length. See, for example, FIG. 38C, which shows that conjugation of either stearic acid or turbinaric acid to the oligonucleotide, which administered at 38 mg/kg, increased distribution to heart tissue, particularly at Day 3 and 8, but did not increase it to the level of WV-942, which is known to have an undesirably long half-life.

In some embodiments, provided oligonucleotide compositions further comprise one or more lipids. In some embodiments, provided oligonucleotide compositions further comprise one or more fatty acids. In some embodiments, the lipids are conjugated to provided oligonucleotides in the compositions. In some embodiments, two or more same or different lipids can be conjugated to one oligonucleotide, through either the same or differently chemistry and/or locations. In some embodiments, a composition can comprise an oligonucleotide disclosed herein (as non-limiting examples, a chirally controlled oligonucleotide composition, or a chirally controlled oligonucleotide composition wherein the sequence of the oligonucleotide comprises, consists of or is the sequence of any oligonucleotide disclosed herein, or a chirally controlled oligonucleotide composition wherein the sequence of the oligonucleotide comprises, consists of or is the sequence of any oligonucleotide disclosed in Table 8 or any other Table herein, etc.) and a lipid. In some embodiments, a provided oligonucleotide comprises base sequence, pattern of backbone linkages, pattern or backbone chiral centers, and/or pattern of chemical modifications (e.g., base modifications, sugar modifications, etc.) of any oligonucleotide disclosed herein, and is conjugated to a lipid. In some embodiments, a provided composition comprises an oligonucleotide disclosed herein and a lipid, wherein the lipid is conjugated to the oligonucleotide.

In some embodiments, the present disclosure provides a composition comprising an oligonucleotide and a lipid. Many lipids can be utilized in provided technologies in accordance with the present disclosure.

In some embodiments, a lipid comprises an $R^{LD}$ group, wherein $R^{LD}$ is an optionally substituted, $C_{10}$-$C_{80}$ saturated or partially unsaturated aliphatic group, wherein one or more methylene units are optionally and independently replaced by an optionally substituted group selected from $C_1$-$C_6$ alkylene, $C_1$-$C_6$ alkenylene, —C≡C—, a $C_1$-$C_6$ heteroaliphatic moiety, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$— —SC(O)—, —C(O)S—, —OC(O)—, and —C(O)O—, wherein:

- each R' is independently —R, —C(O)R, —CO$_2$R, or —SO$_2$R, or:
  - two R' are taken together with their intervening atoms to form an optionally substituted aryl, carbocyclic, heterocyclic, or heteroaryl ring;
- -Cy- is an optionally substituted bivalent ring selected from carbocyclylene, arylene, heteroarylene, and heterocyclylene; and
- each R is independently hydrogen, or an optionally substituted group selected from $C_1$-$C_6$ aliphatic, phenyl, carbocyclyl, aryl, heteroaryl, or heterocyclyl.

In some embodiments, a lipid comprises an $R^{LD}$ group, wherein $R^{LD}$ is an optionally substituted, $C_{10}$-$C_{60}$ saturated or partially unsaturated aliphatic group, wherein one or more methylene units are optionally and independently replaced by an optionally substituted group selected from $C_1$-$C_6$ alkylene, $C_1$-$C_6$ alkenylene, —C≡C—, a $C_1$-$C_6$ heteroaliphatic moiety, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$— —SC(O)—, —C(O)S—, —OC(O)—, and —C(O)O—, wherein:

- each R' is independently —R, —C(O)R, —CO$_2$R, or —SO$_2$R, or:
  - two R' are taken together with their intervening atoms to form an optionally substituted aryl, carbocyclic, heterocyclic, or heteroaryl ring;
- -Cy- is an optionally substituted bivalent ring selected from carbocyclylene, arylene, heteroarylene, and heterocyclylene; and
- each R is independently hydrogen, or an optionally substituted group selected from $C_1$-$C_6$ aliphatic, phenyl, carbocyclyl, aryl, heteroaryl, or heterocyclyl.

In some embodiments, a lipid comprises an $R^{LD}$ group, wherein $R^{LD}$ is an optionally substituted, $C_{10}$-$C_{40}$ saturated or partially unsaturated aliphatic group, wherein one or more methylene units are optionally and independently replaced by an optionally substituted group selected from $C_1$-$C_6$ alkylene, $C_1$-$C_6$ alkenylene, —C≡C—, a $C_1$-$C_6$ heteroaliphatic moiety, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$— —SC(O)—, —C(O)S—, —OC(O)—, and —C(O)O—, wherein:

- each R' is independently —R, —C(O)R, —CO$_2$R, or —SO$_2$R, or:
  - two R' are taken together with their intervening atoms to form an optionally substituted aryl, carbocyclic, heterocyclic, or heteroaryl ring;
- -Cy- is an optionally substituted bivalent ring selected from carbocyclylene, arylene, heteroarylene, and heterocyclylene; and
- each R is independently hydrogen, or an optionally substituted group selected from $C_1$-$C_6$ aliphatic, phenyl, carbocyclyl, aryl, heteroaryl, or heterocyclyl.

In some embodiments, $R^{LD}$ is an optionally substituted, $C_{10}$-$C_{80}$ saturated or partially unsaturated aliphatic group, wherein one or more methylene units are optionally and independently replaced by an optionally substituted group selected from $C_1$-$C_6$ alkylene, $C_1$-$C_6$ alkenylene, —C≡C—, a $C_1$-$C_6$ heteroaliphatic moiety, —C(R')$_2$—, and -Cy-. In some embodiments, $R^{LD}$ is an optionally substituted, $C_{10}$-$C_{60}$ saturated or partially unsaturated aliphatic group, wherein one or more methylene units are optionally and independently replaced by an optionally substituted group selected from $C_1$-$C_6$ alkylene, $C_1$-$C_6$ alkenylene, —C≡C—, a $C_1$-$C_6$ heteroaliphatic moiety, —C(R')$_2$—, and -Cy-. In some embodiments, $R^{LD}$ is a hydrocarbon group consisting carbon and hydrogen atoms.

In some embodiments, $R^{LD}$ is an optionally substituted, $C_{10}$-$C_{60}$ saturated or partially unsaturated aliphatic group, wherein one or more methylene units are optionally and independently replaced by an optionally substituted group selected from $C_1$-$C_6$ alkylene, $C_1$-$C_6$ alkenylene, —C≡C—, a $C_1$-$C_6$ heteroaliphatic moiety, —C(R')$_2$—, and -Cy-. In some embodiments, $R^{LD}$ is an optionally substituted, $C_{10}$-$C_{60}$ saturated or partially unsaturated aliphatic group, wherein one or more methylene units are optionally and independently replaced by an optionally substituted group selected from $C_1$-$C_6$ alkylene, $C_1$-$C_6$ alkenylene, —C≡C—, a $C_1$-$C_6$ heteroaliphatic moiety, —C(R')$_2$—, and -Cy-. In some embodiments, $R^{LD}$ is a hydrocarbon group consisting carbon and hydrogen atoms.

In some embodiments, $R^{LD}$ is an optionally substituted, $C_{10}$-$C_{40}$ saturated or partially unsaturated aliphatic group, wherein one or more methylene units are optionally and independently replaced by an optionally substituted group selected from $C_1$-$C_6$ alkylene, $C_1$-$C_6$ alkenylene, —C≡C—, a $C_1$-$C_6$ heteroaliphatic moiety, —C(R')$_2$—, and -Cy-. In some embodiments, $R^{LD}$ is an optionally substituted, $C_{10}$-$C_{60}$ saturated or partially unsaturated aliphatic group, wherein one or more methylene units are optionally and independently replaced by an optionally substituted group selected from $C_1$-$C_6$ alkylene, $C_1$-$C_6$ alkenylene, —C≡C—, a $C_1$-$C_6$ heteroaliphatic moiety, —C(R')$_2$—, and -Cy-. In some embodiments, $R^{LD}$ is a hydrocarbon group consisting carbon and hydrogen atoms.

The aliphatic group of $R^{LD}$ can be a variety of suitable length. In some embodiments, it is $C_{10}$-$C_{80}$. In some embodiments, it is $C_{10}$-$C_{75}$. In some embodiments, it is $C_{10}$-$C_{70}$. In some embodiments, it is $C_{10}$-$C_{65}$. In some embodiments, it is $C_{10}$-$C_{60}$. In some embodiments, it is $C_{10}$-$C_{50}$. In some embodiments, it is $C_{10}$-$C_{40}$. In some embodiments, it is $C_{10}$-$C_{35}$. In some embodiments, it is $C_{10}$-$C_{30}$. In some embodiments, it is $C_{10}$-$C_{25}$. In some embodiments, it is $C_{10}$-$C_{24}$. In some embodiments, it is $C_{10}$-$C_{23}$. In some embodiments, it is $C_{10}$-$C_{22}$. In some embodiments, it is $C_{10}$-$C_{21}$. In some embodiments, it is $C_{12}$-$C_{22}$. In some embodiments, it is $C_{13}$-$C_{22}$. In some embodiments, it is $C_{14}$-$C_{22}$. In some embodiments, it is $C_{15}$-$C_{22}$. In some embodiments, it is $C_{16}$-$C_{22}$. In some embodiments, it is $C_{17}$-$C_{22}$. In some embodiments, it is $C_{18}$-$C_{22}$. In some embodiments, it is $C_{10}$-$C_{20}$. In some embodiments, the lower end of the range is $C_{10}$, $C_{11}$, $C_{12}$, $C_{13}$, $C_{14}$, $C_{15}$, $C_{16}$, $C_{17}$, or Cis. In some embodiments, the higher end of the range is Cis, $C_{19}$, $C_{20}$, $C_{21}$, $C_{22}$, $C_{23}$, $C_{24}$, $C_{25}$, $C_{26}$, $C_{27}$, $C_{28}$, $C_{29}$, $C_{30}$, $C_{35}$, $C_{40}$, $C_{45}$, $C_{50}$, $C_{55}$, or $C_{60}$. In some embodiments, it is $C_{10}$. In some embodiments, it is $C_{11}$. In some embodiments, it is $C_{12}$. In some embodiments, it is $C_{13}$. In some embodiments, it is $C_{14}$. In some embodiments, it is $C_{15}$. In some embodiments, it is $C_{16}$. In some embodiments, it is $C_{17}$. In some embodiments, it is Cis. In some embodiments, it is $C_{19}$. In some embodiments, it is $C_{20}$. In some embodiments, it is $C_{21}$. In some embodiments, it is $C_{22}$. In some embodiments, it is $C_{23}$. In some embodiments, it is $C_{24}$. In some embodiments, it is $C_{25}$. In some embodiments, it is $C_{30}$. In some embodiments, it is $C_{35}$. In some embodiments, it is $C_{40}$. In some embodiments, it is $C_{45}$. In some embodiments, it is $C_{50}$. In some embodiments, it is $C_{55}$. In some embodiments, it is $C_{60}$.

In some embodiments, a lipid comprises no more than one $R^{LD}$ group. In some embodiments, a lipid comprises two or more $R^{LD}$ groups.

In some embodiments, a lipid is conjugated to a biologically active agent, optionally through a linker, as a moiety comprising an $R^{LD}$ group. In some embodiments, a lipid is conjugated to a biologically active agent, optionally through a linker, as a moiety comprising no more than one $R^{LD}$ group. In some embodiments, a lipid is conjugated to a biologically active agent, optionally through a linker, as an $R^{LD}$ group. In some embodiments, a lipid is conjugated to a biologically active agent, optionally through a linker, as a moiety comprising two or more $R^{LD}$ groups.

In some embodiments, $R^{LD}$ is an optionally substituted, $C_{10}$-$C_{40}$ saturated or partially unsaturated, aliphatic chain. In some embodiments, a lipid comprises an optionally substituted $C_{10}$-$C_{40}$ saturated or partially unsaturated, aliphatic chain.

In some embodiments, $R^{LD}$ is an optionally substituted $C_{10}$-$C_{40}$ linear, saturated or partially unsaturated, aliphatic chain. In some embodiments, a lipid comprises an optionally substituted $C_{10}$-$C_{40}$ linear, saturated or partially unsaturated, aliphatic chain.

In some embodiments, $R^{LD}$ is a $C_{10}$-$C_{40}$ linear, saturated or partially unsaturated, aliphatic chain, optionally substituted with one or more $C_{1-4}$ aliphatic groups. In some embodiments, a lipid comprises a $C_{10}$-$C_{40}$ linear, saturated or partially unsaturated, aliphatic chain, optionally substituted with one or more $C_{1-4}$ aliphatic groups. In some embodiments, $R^{LD}$ is a $C_{10}$-$C_{40}$ linear, saturated or partially unsaturated, aliphatic chain, optionally substituted with one or more $C_{1-2}$ aliphatic groups. In some embodiments, a lipid comprises a $C_{10}$-$C_{40}$ linear, saturated or partially unsaturated, aliphatic chain, optionally substituted with one or more $C_{1-2}$ aliphatic groups. In some embodiments, $R^{LD}$ is a $C_{10}$-$C_{40}$ linear, saturated or partially unsaturated, aliphatic chain, optionally substituted with one or more methyl groups. In some embodiments, a lipid comprises a $C_{10}$-$C_{40}$ linear, saturated or partially unsaturated, aliphatic chain, optionally substituted with one or more methyl groups.

In some embodiments, $R^{LD}$ is an unsubstituted $C_{10}$-$C_{40}$ linear, saturated or partially unsaturated, aliphatic chain. In some embodiments, a lipid comprises an unsubstituted $C_{10}$-$C_{40}$ linear, saturated or partially unsaturated, aliphatic chain.

In some embodiments, a lipid comprises no more than one optionally substituted $C_{10}$-$C_{40}$ linear, saturated or partially unsaturated, aliphatic chain. In some embodiments, a lipid comprises two or more optionally substituted $C_{10}$-$C_{40}$ linear, saturated or partially unsaturated, aliphatic chain.

In some embodiments, $R^{LD}$ is an optionally substituted, $C_{10}$-$C_{60}$ saturated or partially unsaturated, aliphatic chain. In some embodiments, a lipid comprises an optionally substituted $C_{10}$-$C_{60}$ saturated or partially unsaturated, aliphatic chain.

In some embodiments, $R^{LD}$ is an optionally substituted $C_{10}$-$C_{60}$ linear, saturated or partially unsaturated, aliphatic chain. In some embodiments, a lipid comprises an optionally substituted $C_{10}$-$C_{60}$ linear, saturated or partially unsaturated, aliphatic chain.

In some embodiments, $R^{LD}$ is a $C_{10}$-$C_{60}$ linear, saturated or partially unsaturated, aliphatic chain, optionally substituted with one or more $C_{1-4}$ aliphatic groups. In some embodiments, a lipid comprises a $C_{10}$-$C_{60}$ linear, saturated or partially unsaturated, aliphatic chain, optionally substituted with one or more $C_{1-4}$ aliphatic groups. In some embodiments, $R^{LD}$ is a $C_{10}$-$C_{60}$ linear, saturated or partially unsaturated, aliphatic chain, optionally substituted with one or more $C_{1-2}$ aliphatic groups. In some embodiments, a lipid comprises a $C_{10}$-$C_{60}$ linear, saturated or partially unsaturated, aliphatic chain, optionally substituted with one or more $C_{1-2}$ aliphatic groups. In some embodiments, $R^{LD}$ is a $C_{10}$-$C_{60}$ linear, saturated or partially unsaturated, aliphatic chain, optionally substituted with one or more methyl groups. In some embodiments, a lipid comprises a $C_{10}$-$C_{60}$ linear, saturated or partially unsaturated, aliphatic chain, optionally substituted with one or more methyl groups.

In some embodiments, $R^{LD}$ is an unsubstituted $C_{10}$-$C_{60}$ linear, saturated or partially unsaturated, aliphatic chain. In some embodiments, a lipid comprises an unsubstituted $C_{10}$-$C_{60}$ linear, saturated or partially unsaturated, aliphatic chain.

In some embodiments, a lipid comprises no more than one optionally substituted $C_{10}$-$C_{60}$ linear, saturated or partially unsaturated, aliphatic chain. In some embodiments, a lipid comprises two or more optionally substituted $C_{10}$-$C_{60}$ linear, saturated or partially unsaturated, aliphatic chain.

In some embodiments, $R^{LD}$ is an optionally substituted, $C_{10}$-$C_{80}$ saturated or partially unsaturated, aliphatic chain. In some embodiments, a lipid comprises an optionally substituted $C_{10}$-$C_{80}$ saturated or partially unsaturated, aliphatic chain.

In some embodiments, $R^{LD}$ is an optionally substituted $C_{10}$-$C_{80}$ linear, saturated or partially unsaturated, aliphatic chain. In some embodiments, a lipid comprises an optionally substituted $C_{10}$-$C_{80}$ linear, saturated or partially unsaturated, aliphatic chain.

In some embodiments, $R^{LD}$ is a $C_{10}$-$C_{80}$ linear, saturated or partially unsaturated, aliphatic chain, optionally substituted with one or more $C_{1-4}$ aliphatic groups. In some embodiments, a lipid comprises a $C_{10}$-$C_{80}$ linear, saturated or partially unsaturated, aliphatic chain, optionally substituted with one or more $C_{1-4}$ aliphatic groups. In some embodiments, $R^{LD}$ is a $C_{10}$-$C_{80}$ linear, saturated or partially unsaturated, aliphatic chain, optionally substituted with one or more $C_{1-2}$ aliphatic groups. In some embodiments, a lipid comprises a $C_{10}$-$C_{80}$ linear, saturated or partially unsaturated, aliphatic chain, optionally substituted with one or more $C_{1-2}$ aliphatic groups. In some embodiments, $R^{LD}$ is a $C_{10}$-$C_{80}$ linear, saturated or partially unsaturated, aliphatic chain, optionally substituted with one or more methyl groups. In some embodiments, a lipid comprises a $C_{10}$-$C_{80}$ linear, saturated or partially unsaturated, aliphatic chain, optionally substituted with one or more methyl groups.

In some embodiments, $R^{LD}$ is an unsubstituted $C_{10}$-$C_{80}$ linear, saturated or partially unsaturated, aliphatic chain. In some embodiments, a lipid comprises an unsubstituted $C_{10}$-$C_{80}$ linear, saturated or partially unsaturated, aliphatic chain.

In some embodiments, a lipid comprises no more than one optionally substituted $C_{10}$-$C_{80}$ linear, saturated or partially unsaturated, aliphatic chain. In some embodiments, a lipid comprises two or more optionally substituted $C_{10}$-$C_{80}$ linear, saturated or partially unsaturated, aliphatic chain.

In some embodiments, $R^{LD}$ is or comprises a $C_{10}$ saturated linear aliphatic chain. In some embodiments, $R^{LD}$ is or comprises a $C_{10}$ partially unsaturated linear aliphatic chain. In some embodiments, $R^{LD}$ is or comprises a $C_{11}$ saturated linear aliphatic chain. In some embodiments, $R^{LD}$ is or comprises a $C_{11}$ partially unsaturated linear aliphatic chain. In some embodiments, $R^{LD}$ is or comprises a $C_{12}$ saturated linear aliphatic chain. In some embodiments, $R^{LD}$ is or comprises a $C_{12}$ partially unsaturated linear aliphatic chain. In some embodiments, $R^{LD}$ is or comprises a $C_{13}$ saturated linear aliphatic chain. In some embodiments, $R^{LD}$ is or comprises a $C_{13}$ partially unsaturated linear aliphatic chain. In some embodiments, $R^{LD}$ is or comprises a $C_{14}$ saturated linear aliphatic chain. In some embodiments, $R^{LD}$ is or comprises a $C_{14}$ partially unsaturated linear aliphatic chain. In some embodiments, $R^{LD}$ is or comprises a $C_{15}$ saturated linear aliphatic chain. In some embodiments, $R^{LD}$ is or comprises a $C_{15}$ partially unsaturated linear aliphatic chain. In some embodiments, $R^{LD}$ is or comprises a $C_{16}$ saturated linear aliphatic chain. In some embodiments, $R^{LD}$ is or comprises a $C_{16}$ partially unsaturated linear aliphatic chain. In some embodiments, $R^{LD}$ is or comprises a $C_{17}$ saturated linear aliphatic chain. In some embodiments, $R^{LD}$ is or comprises a $C_{17}$ partially unsaturated linear aliphatic chain. In some embodiments, $R^{LD}$ is or comprises a $C_{18}$ saturated linear aliphatic chain. In some embodiments, $R^{LD}$ is or comprises a $C_{18}$ partially unsaturated linear aliphatic chain. In some embodiments, $R^{LD}$ is or comprises a $C_{19}$ saturated linear aliphatic chain. In some embodiments, $R^{LD}$ is or comprises a $C_{19}$ partially unsaturated linear aliphatic chain. In some embodiments, $R^{LD}$ is or comprises a $C_{20}$ saturated linear aliphatic chain. In some embodiments, $R^{LD}$ is or comprises a $C_{20}$ partially unsaturated linear aliphatic chain. In some embodiments, $R^{LD}$ is or comprises a $C_{21}$ saturated linear aliphatic chain. In some embodiments, $R^{LD}$ is or comprises a $C_{21}$ partially unsaturated linear aliphatic chain. In some embodiments, $R^{LD}$ is or comprises a $C_{22}$ saturated linear aliphatic chain. In some embodiments, $R^{LD}$ is or comprises a $C_{22}$ partially unsaturated linear aliphatic chain. In some embodiments, $R^{LD}$ is or comprises a $C_{23}$ saturated linear aliphatic chain. In some embodiments, $R^{LD}$ is or comprises a $C_{23}$ partially unsaturated linear aliphatic chain. In some embodiments, $R^{LD}$ is or comprises a $C_{24}$ saturated linear aliphatic chain. In some embodiments, $R^{LD}$ is or comprises a $C_{24}$ partially unsaturated linear aliphatic chain. In some embodiments, $R^{LD}$ is or comprises a $C_{25}$ saturated linear aliphatic chain. In some embodiments, $R^{LD}$ is or comprises a $C_{25}$ partially unsaturated linear aliphatic chain. In some embodiments, $R^{LD}$ is or comprises a $C_{26}$ saturated linear aliphatic chain. In some embodiments, $R^{LD}$ is or comprises a $C_{26}$ partially unsaturated linear aliphatic chain. In some embodiments, $R^{LD}$ is or comprises a $C_{27}$ saturated linear aliphatic chain. In some embodiments, $R^{LD}$ is or comprises a $C_{27}$ partially unsaturated linear aliphatic chain. In some embodiments, $R^{LD}$ is or comprises a $C_{28}$ saturated linear aliphatic chain. In some embodiments, $R^{LD}$ is or comprises a $C_{28}$ partially unsaturated linear aliphatic chain. In some embodiments, $R^{LD}$ is or comprises a $C_{29}$ saturated linear aliphatic chain. In some embodiments, $R^{LD}$ is or comprises a $C_{29}$ partially unsaturated linear aliphatic chain. In some embodiments, $R^{LD}$ is or comprises a $C_{30}$ saturated linear aliphatic chain. In some embodiments, $R^{LD}$ is or comprises a $C_{30}$ partially unsaturated linear aliphatic chain.

In some embodiments, a lipid has the structure of $R^{LD}$—OH. In some embodiments, a lipid has the structure of $R^{LD}$—C(O)OH. In some embodiments, $R^{LD}$ is

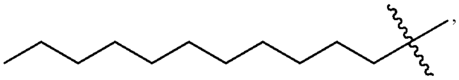,
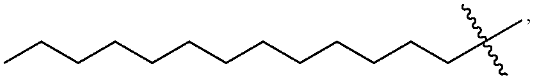,
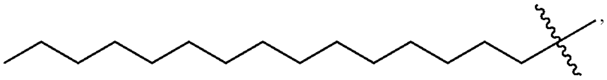,
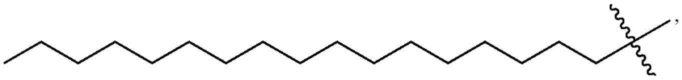,
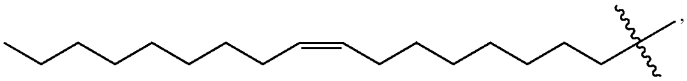,
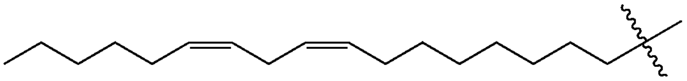, -continued

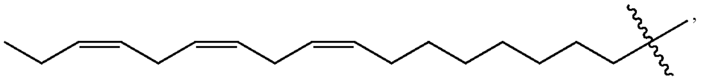

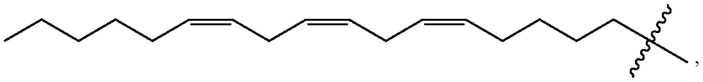

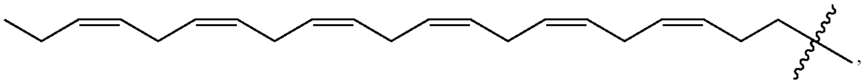

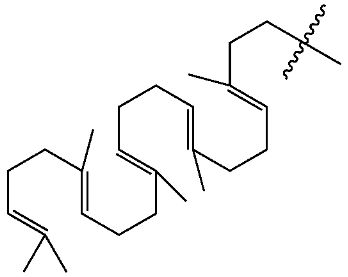

or

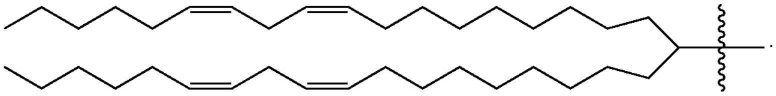

Example oligonucleotides comprising such $R^D$ groups are illustrated, e.g., in Table 4. In some embodiments, a lipid is lauric acid, myristic acid, palmitic acid, stearic acid, oleic acid, linoleic acid, alpha-linolenic acid, gamma-linolenic acid, docosahexaenoic acid (DHA or cis-DHA), turbinaric acid, arachidonic acid, and dilinoleyl. In some embodiments, a lipid is lauric acid, myristic acid, palmitic acid, stearic acid, oleic acid, linoleic acid, alpha-linolenic acid, gamma-linolenic acid, docosahexaenoic acid (DHA or cis-DHA), turbinaric acid and dilinoleyl. In some embodiments, a lipid has a structure of:

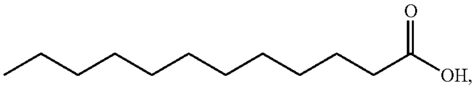

Lauric acid

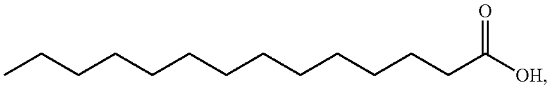

Myristic Acid

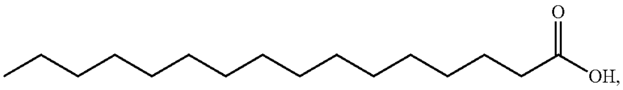

Palmitic Acid

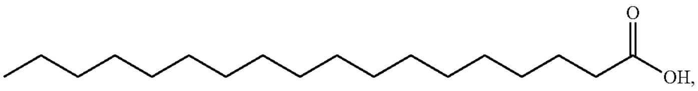

Stearic Acid

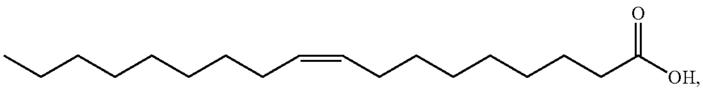

Oleic Acid

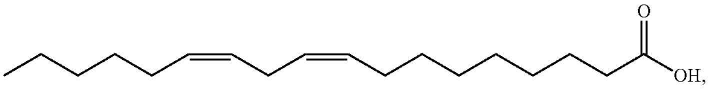

Linoleic acid

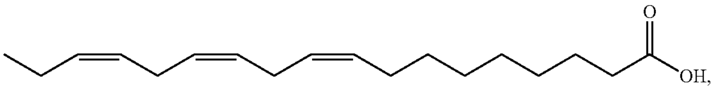

Alpha Linoleic Acid

-continued

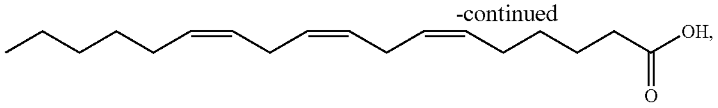

Gamma Linoleic Acid

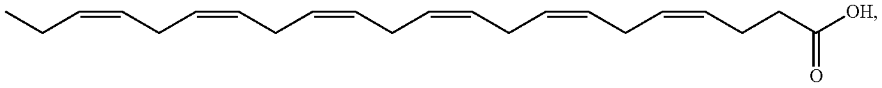

Docosahexaenoic acid

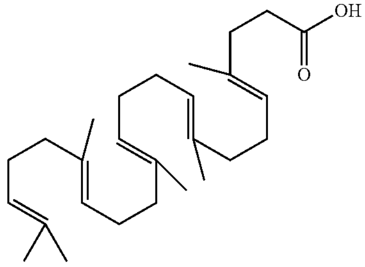

or

Turbinaric acid

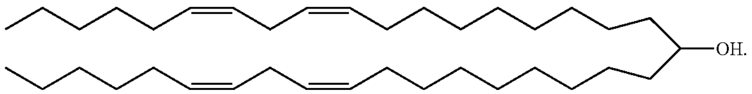

Dilinoleyl methanol

Example oligonucleotides comprising conjugation with these lipids are illustrated, e.g., in Table 4.

In some embodiments, a lipid is, comprises or consists of any of: an at least partially hydrophobic or amphiphilic molecule, a phospholipid, a triglyceride, a diglyceride, a monoglyceride, a fat-soluble vitamin, a sterol, a fat and a wax. In some embodiments, a lipid is any of: a fatty acid, glycerolipid, glycerophospholipid, sphingolipid, sterol lipid, prenol lipid, saccharolipid, polyketide, and other molecule.

Lipids can be incorporated into provided technologies through many types of methods in accordance with the present disclosure. In some embodiments, lipids are physically mixed with provided oligonucleotides to form provided compositions. In some embodiments, lipids are chemically conjugated with oligonucleotides.

In some embodiments, provided compositions comprise two or more lipids. In some embodiments, provided oligonucleotides comprise two or more conjugated lipids. In some embodiments, the two or more conjugated lipids are the same. In some embodiments, the two or more conjugated lipids are different. In some embodiments, provided oligonucleotides comprise no more than one lipid. In some embodiments, oligonucleotides of a provided composition comprise different types of conjugated lipids. In some embodiments, oligonucleotides of a provided composition comprise the same type of lipids.

Lipids can be conjugated to oligonucleotides optionally through linkers. Various types of linkers in the art can be utilized in accordance of the present disclosure. In some embodiments, a linker comprise a phosphate group, which can, for example, be used for conjugating lipids through chemistry similar to those employed in oligonucleotide synthesis. In some embodiments, a linker comprises an amide, ester, or ether group.

In some embodiments, a linker has the structure of -$L^{LD}$-. In some embodiments, $L^{LD}$ is $T^{LD}$ having the structure of

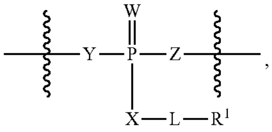, wherein each variable is independently as defined and described. In some embodiments, $T^{LD}$ has the structure of formula I. In some embodiments, $T^{LD}$ with the 5'-O— of an oligonucleotide chain form a phosphorothioate linkage (—OP(O)($S^-$)O—). In some embodiments, $T^{LD}$ with the 5'-O— of an oligonucleotide chain form an Sp phosphorothioate linkage. In some embodiments, $T^{LD}$ with the 5'-O— of an oligonucleotide chain form an Rp phosphorothioate linkage. In some embodiments, $T^{LD}$ with the 5'-O— of an oligonucleotide chain form a phosphate linkage (—OP(O)($O^-$)O—). In some embodiments, $T^{LD}$ with the 5'-O— of an oligonucleotide chain form a phosphorodithioate linkage. In some embodiments, $L^{LD}$ is -L-$T^{LD}$-. In some embodiments, Y connects to -L- and —Z— is a covalent bond, so that P directly connects to a hydroxyl group of the oligonucleotide chain. In some embodiments, P connects to the 5'-end hydroxyl (5'-O—) to form a phosphate group (natural phosphate linkage) or phosphorothioate group (phosphorothioate linkage). In some embodiments, the phosphorothioate linkage is chirally controlled and can be either Rp or Sp. Unless otherwise specified, chiral centers in the linkers (e.g., P in $T^{LD}$) can be either stereorandom or chirally controlled, and they are not considered as part of the backbone chiral centers, e.g., for determining whether a composition is chirally controlled. In some embodiments, $L^{LD}$ is —NH—$(CH_2)_6$-$T^{LD}$-. In some embodiments, $L^{LD}$ is —C(O)—NH—$(CH_2)_6$-$T^{LD}$-.

In some embodiments, a linker has the structure of -L-. In some embodiments, after conjugation to oligonucleotides, a lipid forms a moiety having the structure of -L-$R^{LD}$, wherein each of L and $R^{LD}$ is independently as defined and described herein.

In some embodiments, -L- comprises a bivalent aliphatic chain. In some embodiments, -L- comprises a phosphate group. In some embodiments, -L- comprises a phosphorothioate group. In some embodiments, -L- has the structure of —C(O)NH—$(CH_2)_6$—OP(═O)($S^-$)—. In some embodiments, -L- has the structure of —C(O)NH—$(CH_2)_6$—OP(═O)($O^-$)—.

Lipids, optionally through linkers, can be conjugated to oligonucleotides at various suitable locations. In some embodiments, a compound formed by lipid conjugation has the structure of $(R^{LD}\text{-}L\text{-})_x$-(active compound), wherein x is 1 or an integer greater than 1, and each of $R^{LD}$ and L is independently as defined and described herein. In some embodiments, x is 1. In some embodiments, x is greater than 1. In some embodiments, x is 1-50. In some embodiments, an active compound is an oligonucleotide. For example, in some embodiments, a conjugate has the following structures:

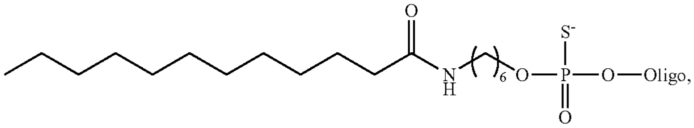
,

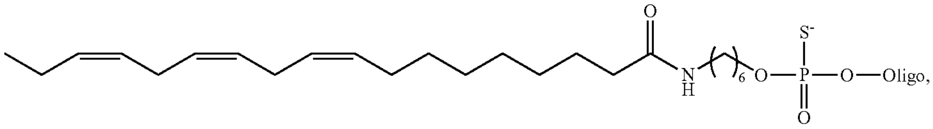
,

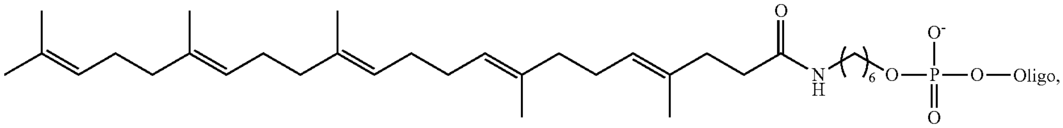
, or

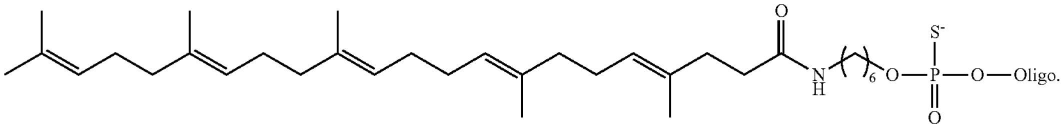
.

embodiments, lipids are conjugated through the 5'-OH group. In some embodiments, lipids are conjugated through the 3'-OH group. In some embodiments, lipids are conjugated through one or more sugar moieties. In some embodiments, lipids are conjugated through one or more bases. In some embodiments, lipids are incorporated through one or more internucleotidic linkages. In some embodiments, an oligonucleotide may contain multiple conjugated lipids which are independently conjugated through its 5'-OH, 3'-OH, sugar moieties, base moieties and/or internucleotidic linkages.

In some embodiments, a linker is a moiety that connects two parts of a composition; as a non-limiting example, a linker physically connects a active compound to a lipid. Non-limiting examples of suitable linkers include: an uncharged linker; a charged linker; a linker comprising an alkyl; a linker comprising a phosphate; a branched linker; an unbranched linker; a linker comprising at least one cleavage group; a linker comprising at least one redox cleavage group; a linker comprising at least one phosphate-based cleavage group; a linker comprising at least one acid-cleavage group; a linker comprising at least one ester-based cleavage group; a linker comprising at least one peptide-based cleavage group.

In some embodiments, a lipid is conjugated to an active compound optionally through a linker moiety. A person having ordinary skill in the art appreciates that various technologies can be utilized to conjugate lipids to active compound in accordance with the present disclosure. For example, for lipids comprising carboxyl groups, such lipids can be conjugated through the carboxyl groups. In some embodiments, a lipid is conjugated through a linker having the structure of -L-, wherein L is as defined and described in formula I. In some embodiments, L comprises a phosphate diester or modified phosphate diester moiety. In some embodiments, a linker is selected from: an uncharged linker; a charged linker; a linker comprising an alkyl; a linker comprising a phosphate; a branched linker; an unbranched linker; a linker comprising at least one cleavage group; a linker comprising at least one redox cleavage group; a linker comprising at least one phosphate-based cleavage group; a linker comprising at least one acid-cleavage group; a linker comprising at least one ester-based cleavage group; and a linker comprising at least one peptide-based cleavage group. In some embodiments, a linker has the structure of -$L^{LD}$-. In some embodiments, a linker has the structure of -L-. In some embodiments, a linker comprises a linkage of formula I. In some embodiments, a linker is —C(O)NH—$(CH_2)_6$-$L^1$-, wherein $L^1$ has the structure of formula I as described herein. In some embodiments, a linker is —C(O)NH—$(CH_2)_6$—O—P(═O)($SR^1$)—O—. In some embodiments, $R^1$ is —H, and a linker is —C(O)NH—$(CH_2)_6$—O—P(═O)(SH)—O—, in some conditions, e.g., certain pH, —C(O)NH—$(CH_2)_6$—O—P(═O)($S^-$)—O—. In some embodiments, a linker is —C(O)NH—$(CH_2)_6$—O—P(═S)($SR^1$)—O—. In some embodiments, $R^1$ is —H, and a linker is —C(O)NH—$(CH_2)_6$—O—P(═S)(SH)—O—, in some conditions, e.g., certain pH, —C(O)NH—$(CH_2)_6$—O—P(═S)($S^-$)—O—. In some embodiments, a linker is —C(O)NH—$(CH_2)_6$—O—P(═S)($OR^1$)—O—, wherein $R^1$ is —$CH_2CH_2CN$. In some embodiments, a linker is —C(O)NH—$(CH_2)_6$—O—P(═S)($SR^1$)—O—, wherein $R^1$ is —$CH_2CH_2CN$. In some embodiments, a provided oligonucleotide is coupled with a linker and forms a structure of H-linker-oligonucleotide. In some embodiments, a provided oligonucleotide is conjugated to a lipid and forms the structure of lipid-linker-oligonucleotide, e.g., $R^{LD}$-$L^{LD}$-oligonucleotide. In some embodiments, the —O— end of a linker is connected to an oligonucleotide. In some embodiments, the —O— end of a linker is connected to the 5'-end oligonucleotide (—O— being the oxygen in the 5'-OH).

In some embodiments, a linker comprises a PO (phosphodiester linkage), a PS (phosphorothioate linkage) or PS2 (phosphorodithioate linkage). A non-limiting example including a PS linker is shown below. In some embodiments, a linker is —O—P(O)(OH)—O— [phosphodiester], —O—P(O)(SH)—O— [phosphorothioate] or —O—P(S)(SH)—O— [phosphorodithioate]. In some embodiments, a linker comprises a $C_6$ amino moiety (—NH—$(CH_2)_6$—), which is illustrated below. In some embodiments, a linker comprises a $C_6$ amino bound to a PO, a PS, or PS2. In some embodiments, a linker is a $C_6$ amino bound to a PO, a PS, or PS2. In some embodiments, a linker, e.g., $L^{LD}$ or L, is —C(O)—NH—$(CH_2)_6$—P(O)(OH)—. In some embodiments, a linker, e.g., $L^{LD}$ or L, is —C(O)—NH—$(CH_2)_6$—P(O)(OH)—, wherein —C(O)— is connected to a lipid moiety and —P(O)(OH)— is connected to an oligonucleotide chain. In some embodiments, a linker, e.g., $L^{LD}$or L, is —C(O)—NH—$(CH_2)_6$—P(O)(OH)—, wherein —C(O)— is connected to a lipid moiety and —P(O)(OH)— is connected to the 5'-O— of an oligonucleotide chain. In some embodiments, a linker, e.g., $L^{LD}$ or L, is —C(O)—NH—$(CH_2)_6$—P(O)(OH)—, wherein —C(O)— is connected to a lipid moiety and —P(O)(OH)— is connected to the 3'-O— of an oligonucleotide chain. In some embodiments, a linker, e.g., $L^{LD}$ or L, is —C(O)—NH—$(CH_2)_6$—P(O)(SH)—. In some embodiments, a linker, e.g., $L^{LD}$ or L, is —C(O)—NH—$(CH_2)_6$—P(O)(SH)—, wherein —C(O)— is connected to a lipid moiety and —P(O)(SH)— is connected to an oligonucleotide chain. In some embodiments, a linker, e.g., $L^{LD}$ or L, is —C(O)—NH—$(CH_2)_6$—P(O)(SH)—, wherein —C(O)— is connected to a lipid moiety and —P(O)(SH)— is connected to the 5'-O— of an oligonucleotide chain. In some embodiments, a linker, e.g., $L^{LD}$ or L, is —C(O)—NH—$(CH_2)_6$—P(O)(SH)—, wherein —C(O)— is connected to a lipid moiety and —P(O)(SH)— is connected to the 3'-O— of an oligonucleotide chain. In some embodiments, a linker, e.g., $L^{LD}$ or L, is —C(O)—NH—$(CH_2)_6$—P(S)(SH)—. In some embodiments, a linker, e.g., $L^{LD}$ or L, is —C(O)—NH—$(CH_2)_6$—P(S)(SH)—, wherein —C(O)— is connected to a lipid moiety and —P(S)(SH)— is connected to an oligonucleotide chain. In some embodiments, a linker, e.g., $L^{LD}$ or L, is —C(O)—NH—$(CH_2)_6$—P(S)(SH)—, wherein —C(O)— is connected to a lipid moiety and —P(S)(SH)— is connected to the 5'-O— of an oligonucleotide chain. In some embodiments, a linker, e.g., $L^{LD}$ or L, is —C(O)—NH—$(CH_2)_6$—P(S)(SH)—, wherein —C(O)— is connected to a lipid moiety and —P(S)(SH)— is connected to the 3'-O— of an oligonucleotide chain. As appreciated by a person having ordinary skill in the art, at certain pH —P(O)(OH)—, —P(O)(SH)—, —P(S)(SH)— may exist as —P(O)($O^-$)—, —P(O)($S^-$)—, —P(S)($S^-$)—, respectively. In some embodiments, a lipid moiety is $R^{LD}$.

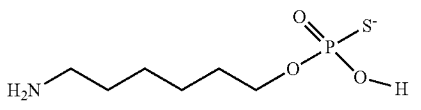

C6 Amino with phosphorothioate

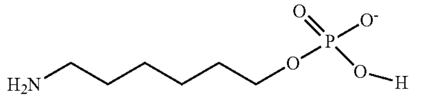

C6 Amino with phosphate

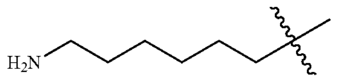

C6 Amino group

Various chemistry and linkers can be used for conjugation in accordance with the present disclosure. For example, lipids, targeting components, etc. can be conjugated to oligonucleotides through linkers using chemistry as described below either on solid phase or insolution phase to prepare certain provided oligonucleotides, for example, those described in Table 4 (WV-2538, WV-2733, WV-2734, WV-2578 to WV-2588, WV-2807, WV-2808, WV-3022 to WV-3027, WV-3029 to WV-3038, WV-3084 to WV-3089, WV-3357 to WV-3366, WV-3517, WV-3520, WV-3543 to WV-3560, WV-3753, WV-3754, WV-3820, WV-3821, WV-3855, WV-3856, WV-3976, WV-3977, WV-3979, WV-3980, WV-4106, WV-4107, etc.):

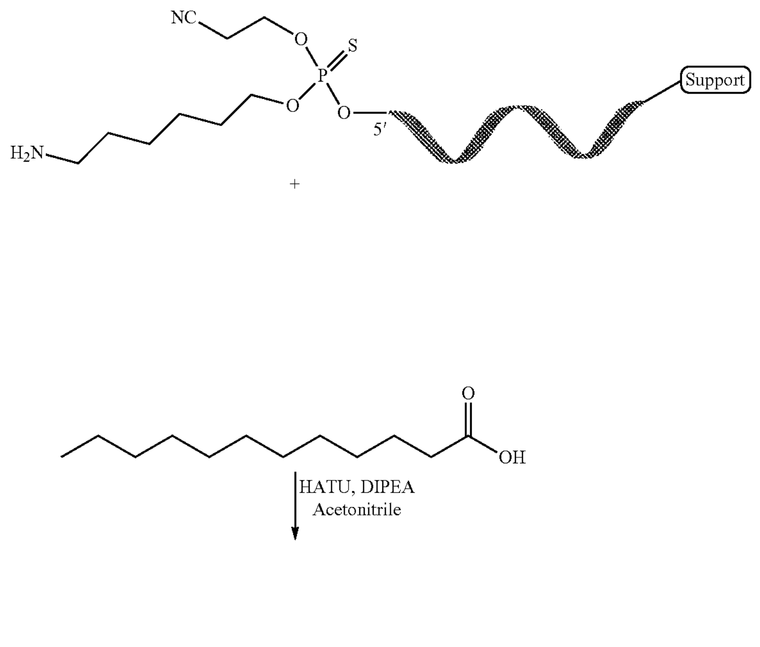

-continued
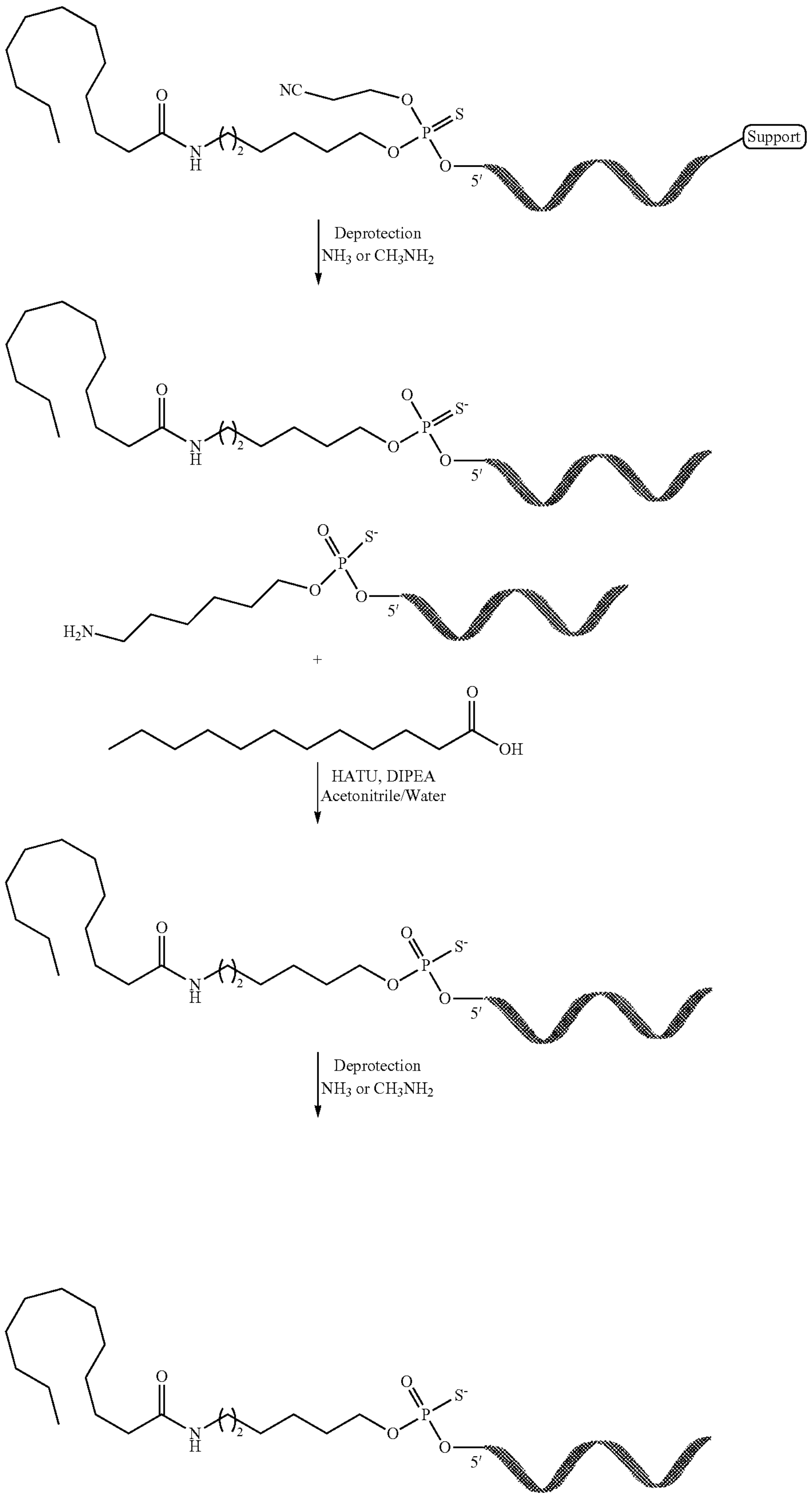

In some embodiments, the present disclosure pertains to compositions and methods related to a composition comprising an oligonucleotide and a lipid comprising a $C_{10}$-$C_{40}$ linear, saturated or partially unsaturated, aliphatic chain, wherein the lipid is conjugated to the biologically active agent. In some embodiments, the present disclosure pertains to compositions and methods related to a composition comprising an oligonucleotide and a lipid comprising a $C_{10}$-$C_{40}$ linear, saturated or partially unsaturated, aliphatic chain, optionally substituted with one or more $C_{1-4}$ aliphatic group, wherein the lipid is conjugated to the biologically active agent.

In some embodiments, the present disclosure pertains to compositions and methods related to a composition comprising an oligonucleotide and a lipid comprising a $C_{10}$-$C_{40}$ linear, saturated or partially unsaturated, aliphatic chain, wherein the lipid is not conjugated to the biologically active agent. In some embodiments, the present disclosure pertains to compositions and methods related to a composition comprising an oligonucleotide and a lipid comprising a $C_{10}$-$C_{40}$ linear, saturated or partially unsaturated, aliphatic chain, optionally substituted with one or more $C_{1-4}$ aliphatic group, wherein the lipid is not conjugated to the biologically active agent.

In some embodiments, a composition comprises an oligonucleotide and a lipid selected from: lauric acid, myristic acid, palmitic acid, stearic acid, oleic acid, linoleic acid, alpha-linolenic acid, gamma-linolenic acid, docosahexaenoic acid (cis-DHA), turbinaric acid, arachidonic acid, and dilinoleyl, wherein the lipid is not conjugated to the biologically active agent. In some embodiments, a composition comprises an oligonucleotide and a lipid selected from: lauric acid, myristic acid, palmitic acid, stearic acid, oleic acid, linoleic acid, alpha-linolenic acid, gamma-linolenic acid, docosahexaenoic acid (cis-DHA), turbinaric acid and dilinoleyl, wherein the lipid is not conjugated to the biologically active agent.

In some embodiments, a composition comprises an oligonucleotide and a lipid selected from: lauric acid, myristic acid, palmitic acid, stearic acid, oleic acid, linoleic acid, alpha-linolenic acid, gamma-linolenic acid, docosahexaenoic acid (cis-DHA), turbinaric acid, arachidonic acid, and dilinoleyl, wherein the lipid is conjugated to the biologically active agent. In some embodiments, a composition comprises an oligonucleotide and a lipid selected from: lauric acid, myristic acid, palmitic acid, stearic acid, oleic acid, linoleic acid, alpha-linolenic acid, gamma-linolenic acid, docosahexaenoic acid (cis-DHA), turbinaric acid and dilinoleyl, wherein the lipid is conjugated to the biologically active agent.

In some embodiments, a composition comprises an oligonucleotide and a lipid selected from: lauric acid, myristic acid, palmitic acid, stearic acid, oleic acid, linoleic acid, alpha-linolenic acid, gamma-linolenic acid, docosahexaenoic acid (cis-DHA), turbinaric acid, arachidonic acid, and dilinoleyl, wherein the lipid is directly conjugated to the biologically active agent (without a linker interposed between the lipid and the biologically active agent). In some embodiments, a composition comprises an oligonucleotide and a lipid selected from: lauric acid, myristic acid, palmitic acid, stearic acid, oleic acid, linoleic acid, alpha-linolenic acid, gamma-linolenic acid, docosahexaenoic acid (cis-DHA), turbinaric acid and dilinoleyl, wherein the lipid is directly conjugated to the biologically active agent (without a linker interposed between the lipid and the biologically active agent).

In some embodiments, a composition comprises an oligonucleotide and a lipid selected from: lauric acid, myristic acid, palmitic acid, stearic acid, oleic acid, linoleic acid, alpha-linolenic acid, gamma-linolenic acid, docosahexaenoic acid (cis-DHA), turbinaric acid, arachidonic acid, and dilinoleyl, wherein the lipid is indirectly conjugated to the biologically active agent (with a linker interposed between the lipid and the biologically active agent). In some embodiments, a composition comprises an oligonucleotide and a lipid selected from: lauric acid, myristic acid, palmitic acid, stearic acid, oleic acid, linoleic acid, alpha-linolenic acid, gamma-linolenic acid, docosahexaenoic acid (cis-DHA), turbinaric acid and dilinoleyl, wherein the lipid is indirectly conjugated to the biologically active agent (with a linker interposed between the lipid and the biologically active agent).

A linker is a moiety that connects two parts of a composition; as a non-limiting example, a linker physically connects an oligonucleotide to a lipid. Non-limiting examples of suitable linkers include: an uncharged linker; a charged linker; a linker comprising an alkyl; a linker comprising a phosphate; a branched linker; an unbranched linker; a linker comprising at least one cleavage group; a linker comprising at least one redox cleavage group; a linker comprising at least one phosphate-based cleavage group; a linker comprising at least one acid-cleavage group; a linker comprising at least one ester-based cleavage group; a linker comprising at least one peptide-based cleavage group. In some embodiments, a linker is an uncharged linker or a charged linker. In some embodiments, a linker comprises an alkyl.

In some embodiments, a linker comprises a phosphate. In various embodiments, a phosphate can also be modified by replacement of a bridging oxygen, (i.e. oxygen that links the phosphate to the nucleoside), with nitrogen (bridged phosphoroamidates), sulfur (bridged phosphorothioates) and carbon (bridged methylenephosphonates). The replacement can occur at the either linking oxygen or at both the linking oxygens. In some embodiments, the bridging oxygen is the 3'-oxygen of a nucleoside, replacement with carbon is done. In some embodiments, the bridging oxygen is the 5'-oxygen of a nucleoside, replacement with nitrogen is done. In various embodiments, the linker comprising a phosphate comprises any one or more of: a phosphorodithioate, phosphoramidate, boranophosphonoate, or a compound of formula (I):

(I)

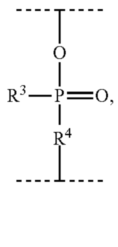

where $R^3$ is selected from OH, SH, $NH_2$, $BH_3$, $CH_3$, $C_{1-6}$ alkyl, $C_{6-10}$ aryl, $C_{1-6}$ alkoxy and $C_{6-10}$ aryl-oxy, wherein $C_{1-6}$ alkyl and $C_{6-10}$ aryl are unsubstituted or optionally independently substituted with 1 to 3 groups independently selected from halo, hydroxyl and $NH_2$; and $R^4$ is selected from O, S, NH, or $CH_2$.

In some embodiments, a linker comprises a direct bond or an atom such as oxygen or sulfur, a unit such as $NR^1$, C(O), C(O)NH, SO, $SO_2$, $SO_2NH$ or a chain of atoms, such as substituted or unsubstituted alkyl, substituted or unsubstituted alkenyl, substituted or unsubstituted alkynyl, arylalkyl, arylalkenyl, arylalkynyl, heteroarylalkyl, heteroarylalkenyl, heteroarylalkynyl, heterocyclylalkyl, heterocyclylalkenyl, heterocyclylalkynyl, aryl, heteroaryl, heterocyclyl, cycloalkyl, cycloalkenyl, alkylarylalkyl, alkylarylalkenyl, alkylarylalkynyl, alkenylarylalkyl, alkenylarylalkenyl, alkenylarylalkynyl, alkynylarylalkyl, alkynylarylalkenyl, alkynylarylalkynyl, alkylheteroarylalkyl, alkylheteroarylalkenyl, alkylheteroarylalkynyl, alkenylheteroarylalkyl, alkenylheteroarylalkenyl, alkenylheteroarylalkynyl, alkynylheteroarylalkyl, alkynylheteroarylalkenyl, alkynylheteroarylalkynyl, alkylheterocyclylalkyl, alkylheterocyclylalkenyl, alkylhererocyclylalkynyl, alkenylheterocyclylalkyl, alkenylheterocyclylalkenyl, alkenylheterocyclylalkynyl, alkynylheterocyclylalkyl, alkynylheterocyclylalkenyl, alkynylheterocyclylalkynyl, alkylaryl, alkenylaryl, alkynylaryl, alkylheteroaryl, alkenylheteroaryl, alkynylhereroaryl, where one or more methylenes can be interrupted or terminated by O, S, S(O), $SO_2$, $N(R_1)_2$, C(O), cleavable linking group, substituted or unsubstituted aryl, substituted or unsubstituted heteroaryl, substituted or unsubstituted heterocyclic; where $R^1$ is hydrogen, acyl, aliphatic or substituted aliphatic.

In some embodiments, a linker is a branched linker. In some embodiments, a branchpoint of the branched linker may be at least trivalent, but may be a tetravalent, pentavalent or hexavalent atom, or a group presenting such multiple valencies. In some embodiments, a branchpoint is —N, —N(Q)-C, —O—C, —S—C, —SS—C, —C(O)N(Q)-C, —OC(O)N(Q)-C, —N(Q)C(O)—C, or —N(Q)C(O)O—C; wherein Q is independently for each occurrence H or optionally substituted alkyl. In other embodiment, the branchpoint is glycerol or glycerol derivative.

In one embodiment, a linker comprises at least one cleavable linking group.

As a non-limiting example, a cleavable linking group can be sufficiently stable outside the cell, but which upon entry into a target cell is cleaved to release the two parts the linker is holding together. As a non-limiting example, a cleavable linking group is cleaved at least 10 times or more, at least 100 times faster in the target cell or under a first reference condition (which can, e.g., be selected to mimic or represent intracellular conditions) than in the blood of a subject, or under a second reference condition (which can, e.g., be selected to mimic or represent conditions found in the blood or serum). Cleavable linking groups are susceptible to cleavage agents, e.g., pH, redox potential or the presence of degradative molecules. Generally, cleavage agents are more prevalent or found at higher levels or activities inside cells than in serum or blood. Examples of such degradative agents include: redox agents which are selected for particular substrates or which have no substrate specificity, including, e.g., oxidative or reductive enzymes or reductive agents such as mercaptans, present in cells, that can degrade a redox cleavable linking group by reduction; esterases; endosomes or agents that can create an acidic environment, e.g., those that result in a pH of five or lower; enzymes that can hydrolyze or degrade an acid cleavable linking group by acting as a general acid, peptidases (which can be substrate specific), and phosphatases.

As a non-limiting example, a cleavable linkage group, such as a disulfide bond can be susceptible to pH. The pH of human serum is 7.4, while the average intracellular pH is slightly lower, ranging from about 7.1-7.3. Endosomes have a more acidic pH, in the range of 5.5-6.0, and lysosomes have an even more acidic pH at around 5.0. Some linkers will have a cleavable linking group that is cleaved at a desired pH, thereby releasing the cationic lipid from the ligand inside the cell, or into the desired compartment of the cell.

As a non-limiting example, a linker can include a cleavable linking group that is cleavable by a particular enzyme. The type of cleavable linking group incorporated into a linker can depend on the cell to be targeted. For example, liver targeting ligands can be linked to the cationic lipids through a linker that includes an ester group. Liver cells are rich in esterases, and therefore the linker will be cleaved more efficiently in liver cells than in cell types that are not esterase-rich. Other cell-types rich in esterases include cells of the lung, renal cortex, and testis.

As a non-limiting example, a linker can contain a peptide bond, which can be used when targeting cell types rich in peptidases, such as liver cells and synoviocytes.

As a non-limiting example, suitability of a candidate cleavable linking group can be evaluated by testing the ability of a degradative agent (or condition) to cleave the candidate linking group. It will also be desirable to also test the candidate cleavable linking group for the ability to resist cleavage in the blood or when in contact with other non-target tissue. Thus one can determine the relative susceptibility to cleavage between a first and a second condition, where the first is selected to be indicative of cleavage in a target cell and the second is selected to be indicative of cleavage in other tissues or biological fluids, e.g., blood or serum. The evaluations can be carried out in cell free systems, in cells, in cell culture, in organ or tissue culture, or in whole animals. It may be useful to make initial evaluations in cell-free or culture conditions and to confirm by further evaluations in whole animals. As a non-limiting example, useful candidate compounds are cleaved at least 2, 4, 10 or 100 times faster in the cell (or under in vitro conditions selected to mimic intracellular conditions) as compared to blood or serum (or under in vitro conditions selected to mimic extracellular conditions).

In some embodiments, a linker comprises a redox cleavable linking group. As a non-limiting example, one class of cleavable linking groups are redox cleavable linking groups that are cleaved upon reduction or oxidation. A non-limiting example of reductively cleavable linking group is a disulphide linking group (—S—S—). To determine if a candidate cleavable linking group is a suitable "reductively cleavable linking group," or for example is suitable for use with a particular oligonucleotide moiety and particular targeting agent one can look to methods described herein. As a non-limiting example, a candidate can be evaluated by incubation with dithiothreitol (DTT), or other reducing agent using reagents know in the art, which mimic the rate of cleavage which would be observed in a cell, e.g., a target cell. The candidates can also be evaluated under conditions which are selected to mimic blood or serum conditions. As a non-limiting example, candidate compounds are cleaved by at most 10% in the blood. As a non-limiting example, useful candidate compounds are degraded at least 2, 4, 10 or 100 times faster in the cell (or under in vitro conditions selected to mimic intracellular conditions) as compared to blood (or under in vitro conditions selected to mimic extracellular conditions). The rate of cleavage of candidate compounds can be determined using standard enzyme kinetics assays under conditions chosen to mimic intracellular media and compared to conditions chosen to mimic extracellular media.

In some embodiments, a linker comprises a phosphate-based cleavable linking groups are cleaved by agents that degrade or hydrolyze the phosphate group. An example of an agent that cleaves phosphate groups in cells are enzymes such as phosphatases in cells. Examples of phosphate-based linking groups are —O—P(O)(ORk)-O—, —O—P(S)(ORk)-O—, —O—P(S)(SRk)-O—, —S—P(O)(ORk)-O—, —O—P(O)(ORk)-S—, —S—P(O)(ORk)-S—, —O—P(S)(ORk)-S—, —S—P(S)(ORk)-O—, —O—P(O)(Rk)-O—, —O—P(S)(Rk)-O—, —S—P(O)(Rk)-O—, —S—P(S)(Rk)-O—, —S—P(O)(Rk)-S—, —O—P(S)(Rk)-S—. Additional non-limiting examples are —O—P(O)(OH)—O—, —O—P(S)(OH)—O—, —O—P(S)(SH)—O—, —S—P(O)(OH)—O—, —O—P(O)(OH)—S—, —S—P(O)(OH)—S—, —O—P(S)(OH)—S—, —S—P(S)(OH)—O—, —O—P(O)(H)—O—, —O—P(S)(H)—O—, —S—P(O)(H)—O—, —S—P(S)(H)—O—, —S—P(O)(H)—S—, —O—P(S)(H)—S—. An additional non-limiting examples is —O—P(O)(OH)—O—. In various embodiments, Rk is any of: OH, SH, $NH_2$, $BH_3$, $CH_3$, $C_{1-6}$ alkyl, $C_{6-10}$ aryl, $C_{1-6}$ alkoxy and $C_{6-10}$ aryl-oxy, wherein $C_{1-6}$ alkyl and $C_{6-10}$ aryl are unsubstituted or optionally independently substituted with 1 to 3 groups independently selected from halo, hydroxyl and $NH_2$; and $R^4$ is selected from O, S, NH, or $CH_2$.

In some embodiments, a linker comprises an acid cleavable linking groups are linking groups that are cleaved under acidic conditions. As a non-limiting example, acid cleavable linking groups are cleaved in an acidic environment with a pH of about 6.5 or lower (e.g., about 6.0, 5.5, 5.0, or lower), or by agents such as enzymes that can act as a general acid. In a cell, specific low pH organelles, such as endosomes and lysosomes can provide a cleaving environment for acid cleavable linking groups. Examples of acid cleavable linking groups include but are not limited to hydrazones, esters, and esters of amino acids. Acid cleavable groups can have the general formula —C═NN—, C(O)O, or —OC(O). In an additional non-limiting example, when the carbon attached to the oxygen of the ester (the alkoxy group) is an aryl group, substituted alkyl group, or tertiary alkyl group such as dimethyl pentyl or t-butyl.

In some embodiments, a linker comprises an ester-based linking groups. As a non-limiting example, ester-based cleavable linking groups are cleaved by enzymes such as esterases and amidases in cells. Examples of ester-based cleavable linking groups include but are not limited to esters of alkylene, alkenylene and alkynylene groups. Ester cleavable linking groups have the general formula —C(O)O—, or —OC(O)—. These candidates can be evaluated using methods analogous to those described above.

In some embodiments, a linker comprises a peptide-based cleaving group. Peptide-based cleavable linking groups are cleaved by enzymes such as peptidases and proteases in cells. Peptide-based cleavable linking groups are peptide bonds formed between amino acids to yield oligopeptides (e.g., dipeptides, tripeptides etc.) and polypeptides. As a non-limiting example, peptide-based cleavable groups do not include the amide group (—C(O)NH—). The amide group can be formed between any alkylene, alkenylene or alkynylene. A peptide bond is a special type of amide bond formed between amino acids to yield peptides and proteins. As a non-limiting example, a peptide based cleavage group can be limited to the peptide bond (i.e., the amide bond) formed between amino acids yielding peptides and proteins and does not include the entire amide functional group. As a non-limiting example, a peptide-based cleavable linking groups can have the general formula —NHCHR$^A$C(O)NHCHR$^B$C(O)—, where $R^A$ and $R^B$ are the R groups of the two adjacent amino acids. These candidates can be evaluated using methods analogous to those described above.

Any linker reported in the art can be used, including, as non-limiting examples, those described in: U.S. Pat. App. No. 20150265708.

In some embodiments, a lipid is conjugated to an oligonucleotide using any method known in the art in accordance with the present disclosure.

Non-limiting examples of procedures for conjugating a lipid to an oligonucleotide are provided in the Examples. For example, a lipid (e.g., stearic acid or turbinaric acid) can be conjugated to an oligonucleotide (e.g., WV-3473) using a $C_6$ PO linker to produced WV-3545, 5'-Mod015L001fU*fC*fA*fA*fG*fG*mAfA*mGmA*fU*mGmGfC*fA*fU*fU*fU*fC*fU-3' (WV-3545: SEQ ID NO: 838), wherein Mod015L001 is based on stearic acid and $C_6$ PO linker; and WV-3546, 5'-Mod020L001fU*fC*fA*fA*fG*fG*mAfA*mGmA*fU*mGmGfC*fA*fU*fU*fU*fC*fJ-3' (WV-3546: SEQ ID NO: 839), wherein Mod020L001 is based on turbinaric acid and $C_6$ PO linker; WV-3856, 5'-Mod015L001fU*fC*fA*fA*fG*fG*mAfA*mG fA*mUfG*mGfC*fA*fU*fU*fU*fC*fU-3' (WV-3856:

SEQ ID NO: 860), wherein Mod015L001 is based on stearic acid and $C_6$ PO linker; and WV-3559, 5'-Mod020L001fU*fC*fA*fA*fG*fG*mAfA*mGfA*mUfG*mGfC*fA*fU*fU*fU*fC*fU-3' (WV-3559: SEQ ID NO: 852), wherein Mod020L001 is based on turbinaric acid and $C_6$ PO linker. These oligonucleotides were efficacious in various in vitro assays.

Targeting Components

In some embodiments, a provided composition further comprises a targeting component or moiety. A targeting component can be either conjugated or not conjugated to a lipid or a biologically active agent. In some embodiments, a targeting component is conjugated to a biologically active agent. In some embodiments, a biologically active agent is conjugated to both a lipid and a targeting component. As described in here, in some embodiments, a biologically active agent is a provided oligonucleotide. Thus, in some embodiments, a provided oligonucleotide composition further comprises, besides a lipid and oligonucleotides, a target elements. Various targeting components can be used in accordance with the present disclosure, e.g., lipids, antibodies, peptides, carbohydrates, etc. In some embodiments, provided oligonucleotides have the structure of $A^c$-[-$L^{LD}$-$(R^{LD})_a]_b$. In some embodiments, provided oligonucleotides have the structure of $[(A^c)_a$-$L^{LD}]_b$-$R^{LD}$. In some embodiments, $L^{LD}$, $R^{LD}$ combinations of $L^{LD}$ and $R^{LD}$, or -[-$L^{LD}$-$(R^{LD})_a]_b$ comprises one or more targeting components.

Targeting components can be incorporated into provided technologies through many types of methods in accordance with the present disclosure. In some embodiments, targeting components are physically mixed with provided oligonucleotides to form provided compositions. In some embodiments, targeting components are chemically conjugated with oligonucleotides.

In some embodiments, provided compositions comprise two or more targeting components. In some embodiments, provided oligonucleotides comprise two or more conjugated targeting components. In some embodiments, the two or more conjugated targeting components are the same. In some embodiments, the two or more conjugated targeting components are different. In some embodiments, provided oligonucleotides comprise no more than one targeting component. In some embodiments, oligonucleotides of a provided composition comprise different types of conjugated targeting components. In some embodiments, oligonucleotides of a provided composition comprise the same type of targeting components.

Targeting components can be conjugated to oligonucleotides optionally through linkers. Various types of linkers in the art can be utilized in accordance of the present disclosure. In some embodiments, a linker comprise a phosphate group, which can, for example, be used for conjugating targeting components through chemistry similar to those employed in oligonucleotide synthesis. In some embodiments, a linker comprises an amide, ester, or ether group. In some embodiments, a linker has the structure of -L-. Targeting components can be conjugated through either the same or different linkers compared to lipids.

Targeting components, optionally through linkers, can be conjugated to oligonucleotides at various suitable locations. In some embodiments, targeting components are conjugated through the 5'-OH group. In some embodiments, targeting components are conjugated through the 3'-OH group. In some embodiments, targeting components are conjugated through one or more sugar moieties. In some embodiments, targeting components are conjugated through one or more bases. In some embodiments, targeting components are incorporated through one or more internucleotidic linkages. In some embodiments, an oligonucleotide may contain multiple conjugated targeting components which are independently conjugated through its 5'-OH, 3'-OH, sugar moieties, base moieties and/or internucleotidic linkages. Targeting components and lipids can be conjugated either at the same, neighboring and/or separated locations. In some embodiments, a targeting component is conjugated at one end of an oligonucleotide, and a lipid is conjugated at the other end.

In some embodiments, a targeting component interacts with a protein on the surface of targeted cells. In some embodiments, such interaction facilitates internalization into targeted cells. In some embodiments, a targeting component comprises a sugar moiety. In some embodiments, a targeting component comprises a polypeptide moiety. In some embodiments, a targeting component comprises an antibody. In some embodiments, a targeting component is an antibody. In some embodiments, a targeting component comprises an inhibitor. In some embodiments, a targeting component is a moiety from a small molecule inhibitor. In some embodiments, an inhibitor is an inhibitor of a protein on the surface of targeted cells. In some embodiments, an inhibitor is a carbonic anhydrase inhibitor. In some embodiments, an inhibitor is a carbonic anhydrase inhibitor expressed on the surface of target cells. In some embodiments, a carbonic anhydrase is I, II, III, IV, V, VI, VII, VIII, IX, X, XI, XII, XIII, XIV, XV or XVI. In some embodiments, a carbonic anhydrase is membrane bound. In some embodiments, a carbonic anhydrase is IV, IX, XII or XIV. In some embodiments, an inhibitor is for IV, IX, XII and/or XIV. In some embodiments, an inhibitor is a carbonic anhydrase III inhibitor. In some embodiments, an inhibitor is a carbonic anhydrase IV inhibitor. In some embodiments, an inhibitor is a carbonic anhydrase IX inhibitor. In some embodiments, an inhibitor is a carbonic anhydrase XII inhibitor. In some embodiments, an inhibitor is a carbonic anhydrase XIV inhibitor. In some embodiments, an inhibitor comprises or is a sulfonamide (e.g., those described in Supuran, CT. *Nature Rev Drug Discover* 2008, 7, 168-181, which sulfonamides are incorporated herein by reference). In some embodiments, an inhibitor is a sulfonamide. In some embodiments, targeted cells are muscle cells.

In some embodiments, a targeting component is $R^{LD}$ as defined and described in the present disclosure. In some embodiments, the present disclosure provides oligonucleotides comprising $R^{LD}$. In some embodiments, the present disclosure provides oligonucleotide compositions comprising oligonucleotides comprising $R^{LD}$. In some embodiments, the present disclosure provides oligonucleotide compositions comprising a first plurality of oligonucleotides comprising $R^{LD}$. In some embodiments, the present disclosure provides chirally controlled oligonucleotide compositions of oligonucleotides comprising $R^{LD}$. In some embodiments, $R^{LD}$ comprises or is

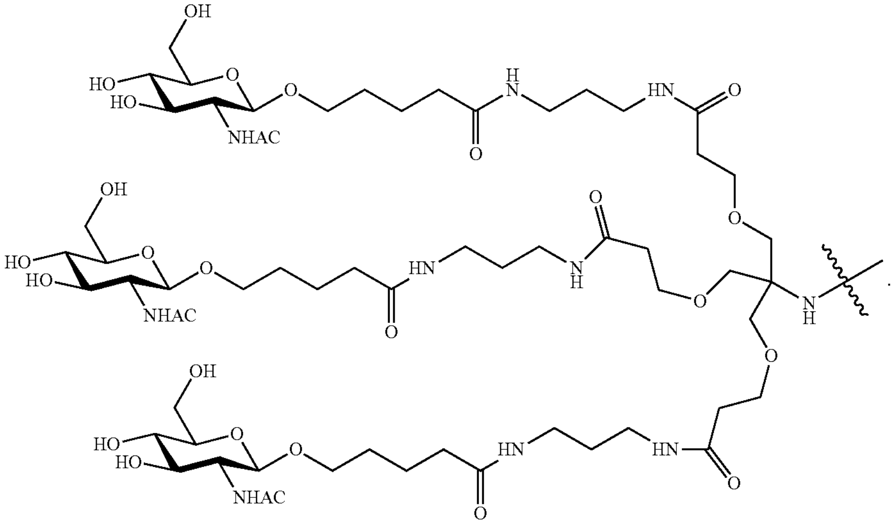

In some embodiments, $R^{LD}$ comprises or is

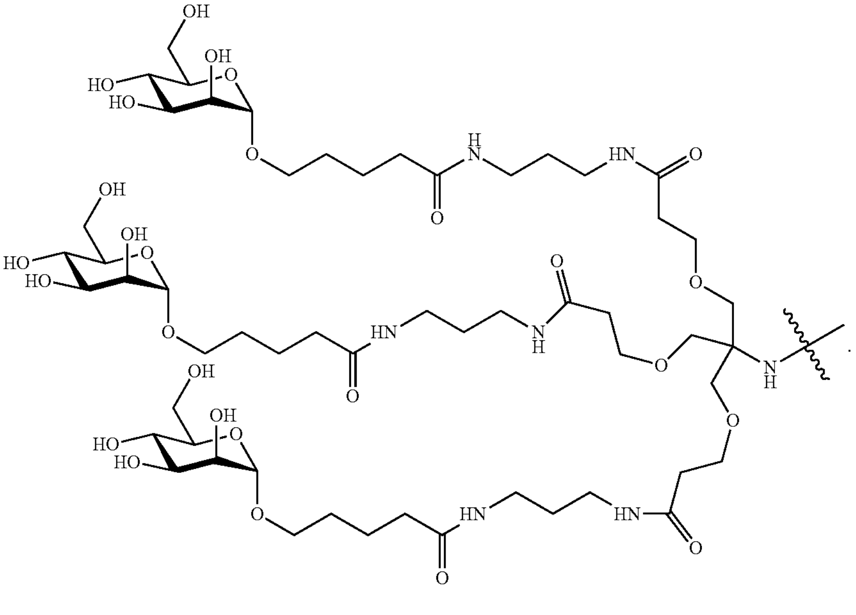

In some embodiments, $R^{LD}$ comprises or is
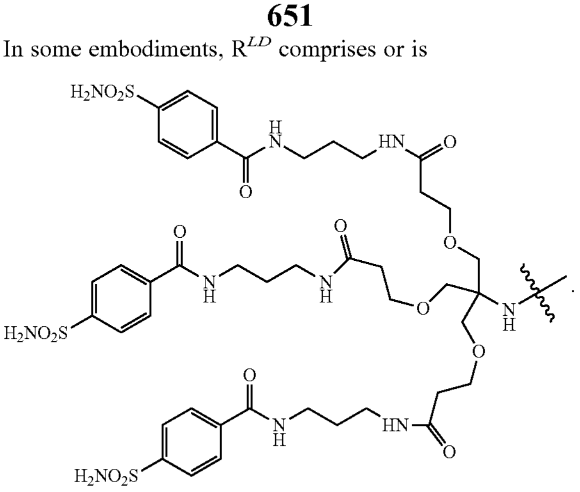
In some embodiments, $R^{LD}$ comprises or is
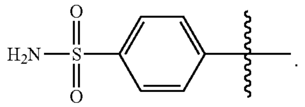 [SMILES: *c1ccc(S(N)(=O)=O)cc1]
In some embodiments, $R^{LD}$ comprises or is
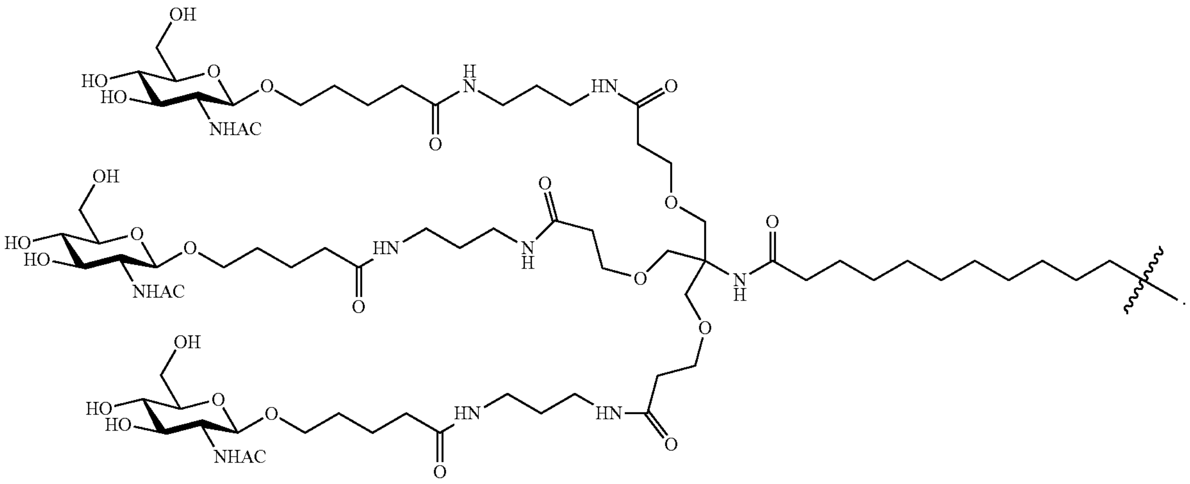
In some embodiments, $R^{LD}$ comprises or is
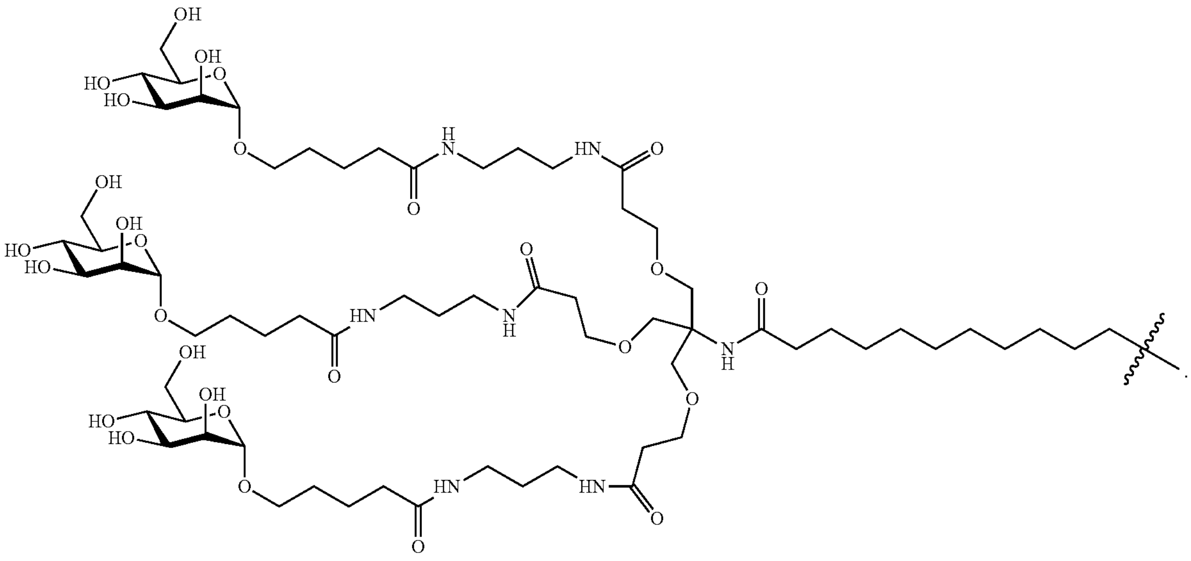

In some embodiments, $R^{LD}$ comprises or is
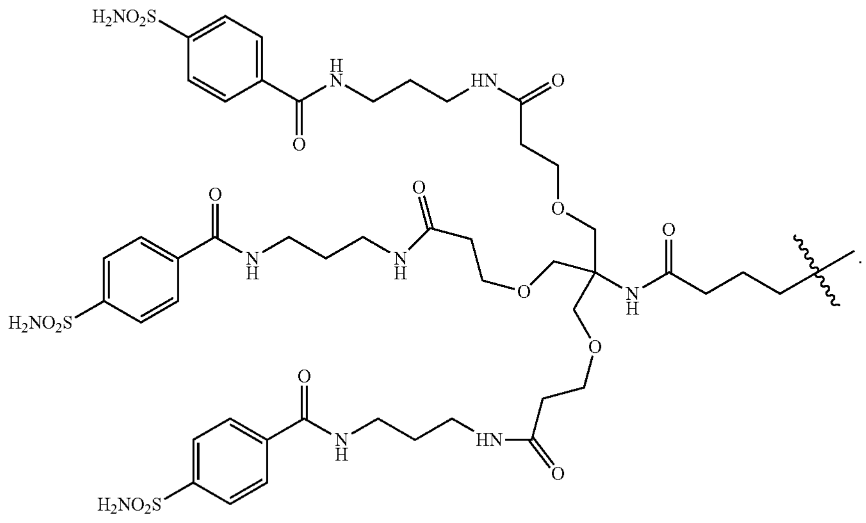 [SMILES: *CCCC(=O)NC(COCCC(=O)NCCCNC(=O)c1ccc(S(N)(=O)=O)cc1)(COCCC(=O)NCCCNC(=O)c1ccc(S(N)(=O)=O)cc1)COCCC(=O)NCCCNC(=O)c1ccc(S(N)(=O)=O)cc1]
In some embodiments, $R^{LD}$ comprises or is
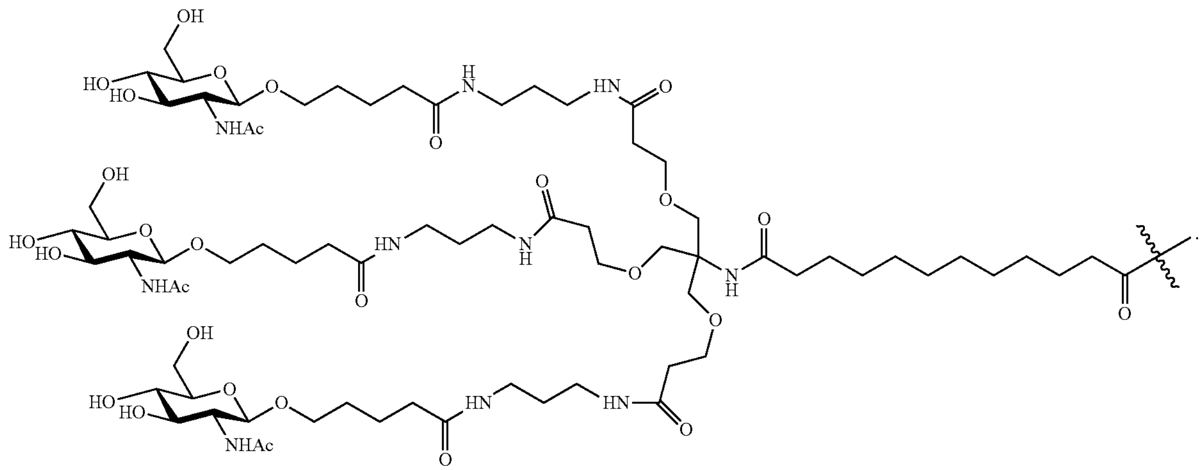

In some embodiments, $R^{LD}$ comprises or is
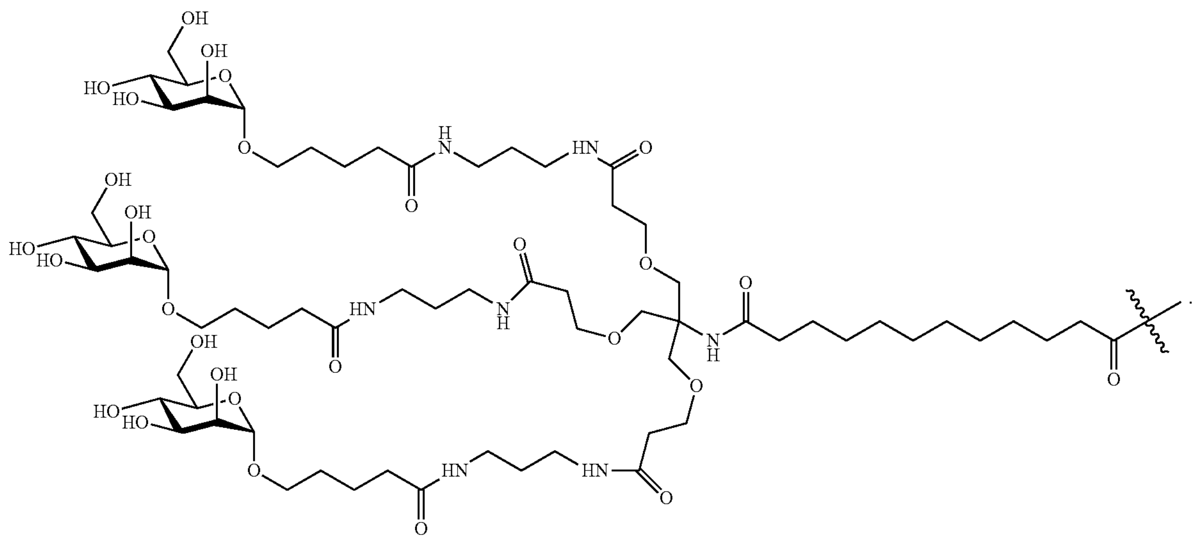
In some embodiments, $R^{LD}$ comprises or is
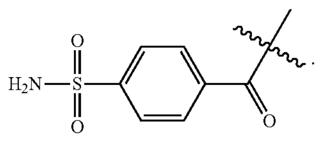
In some embodiments, $R^{LD}$ comprises or is
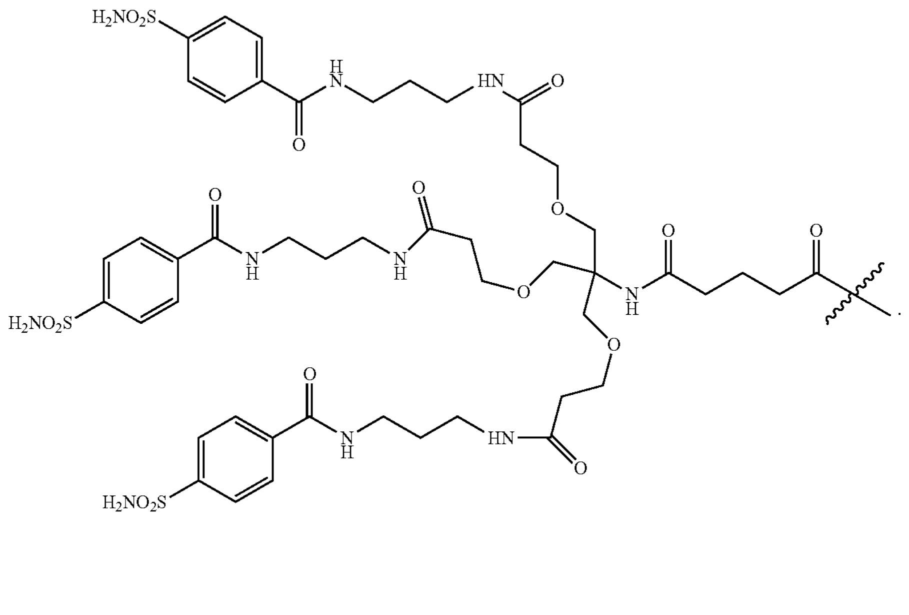 [SMILES: *C(=O)CCCC(=O)NC(COCCC(=O)NCCCNC(=O)c1ccc(S(N)(=O)=O)cc1)(COCCC(=O)NCCCNC(=O)c1ccc(S(N)(=O)=O)cc1)COCCC(=O)NCCCNC(=O)c1ccc(S(N)(=O)=O)cc1]

In some embodiments, $R^{LD}$ comprises or is
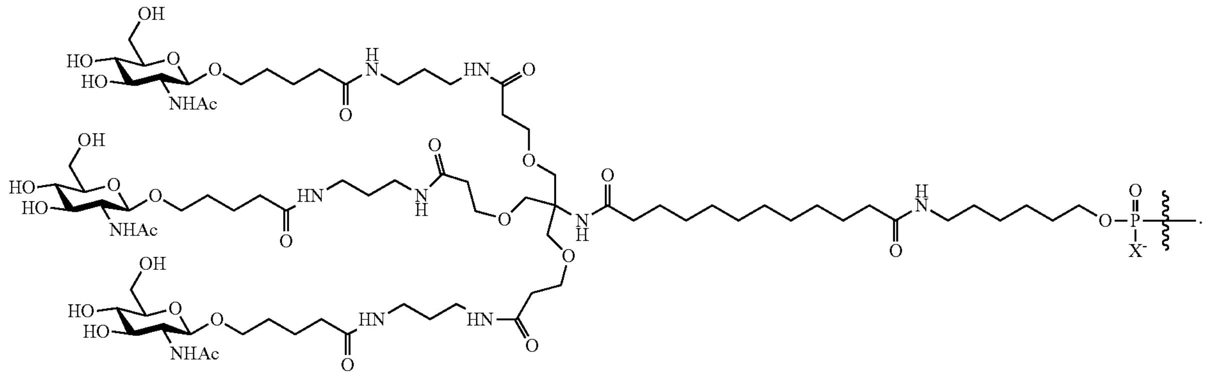
X = O or S
In some embodiments, $R^{LD}$ comprises or is
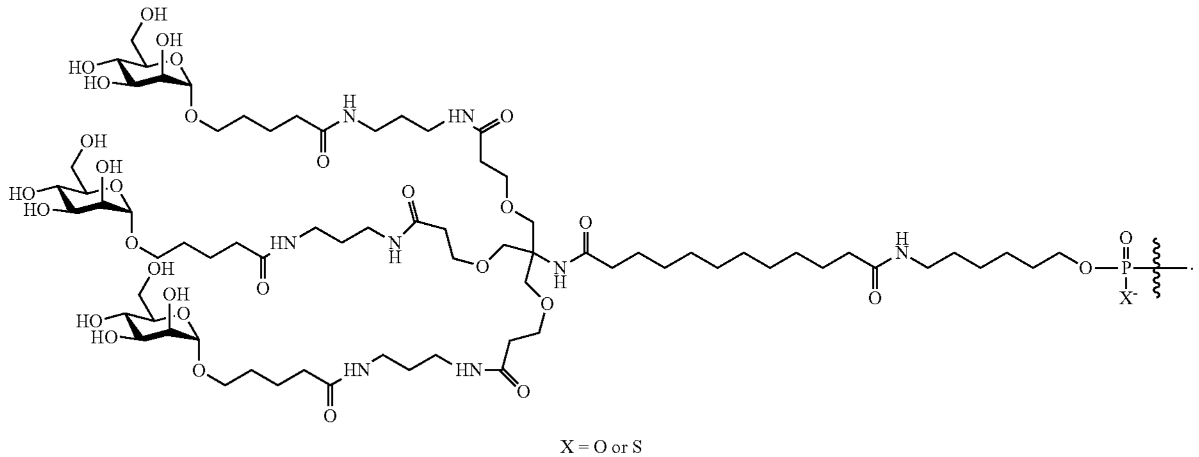
X = O or S In some embodiments, $R^{LD}$ comprises or is

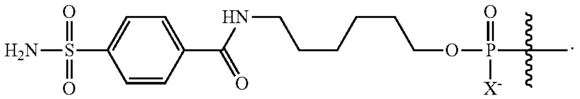

X = O or S

In some embodiments, $R^{LD}$ comprises or is

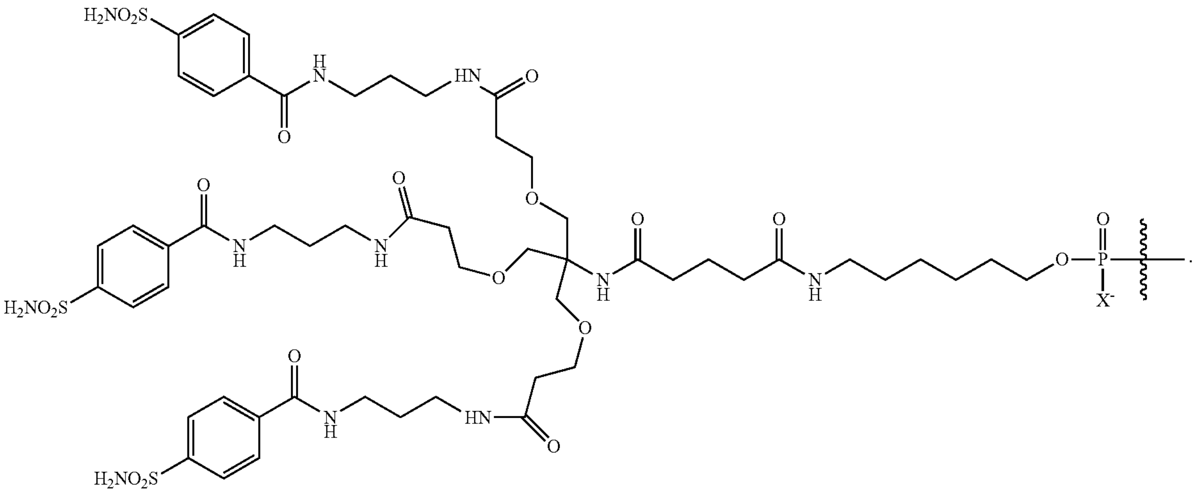

X = O or S

In some embodiments, $R^{LD}$ is a targeting component that comprises or is a lipid moiety. In some embodiments, X is O. In some embodiments, X is S.

In some embodiments, the present disclosure provides technologies (e.g., reagents, methods, etc.) for conjugating various moieties to oligonucleotide chains. In some embodiments, the present disclosure provides technologies for conjugating targeting component to oligonucleotide chains. In some embodiments, the present disclosure provides acids comprising targeting components for conjugation, e.g., $R^{LD}$—COOH. In some embodiments, the present disclosure provides linkers for conjugation, e.g., $L^{LD}$. A person having ordinary skill in the art understands that many known and widely practiced technologies can be utilized for conjugation with oligonucleotide chains in accordance with the present disclosure. In some embodiments, a provided acid is

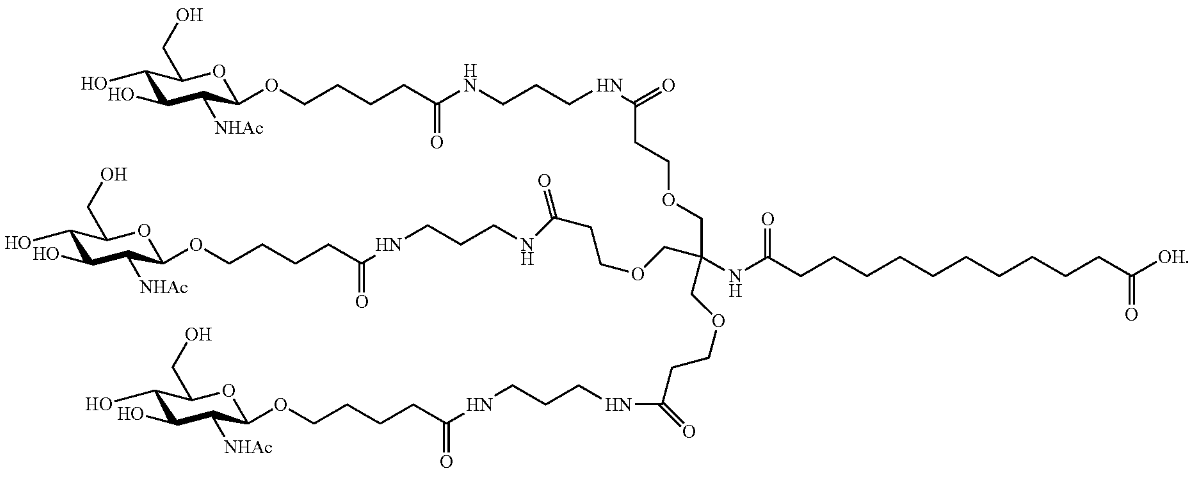

In some embodiments, a provided acid is

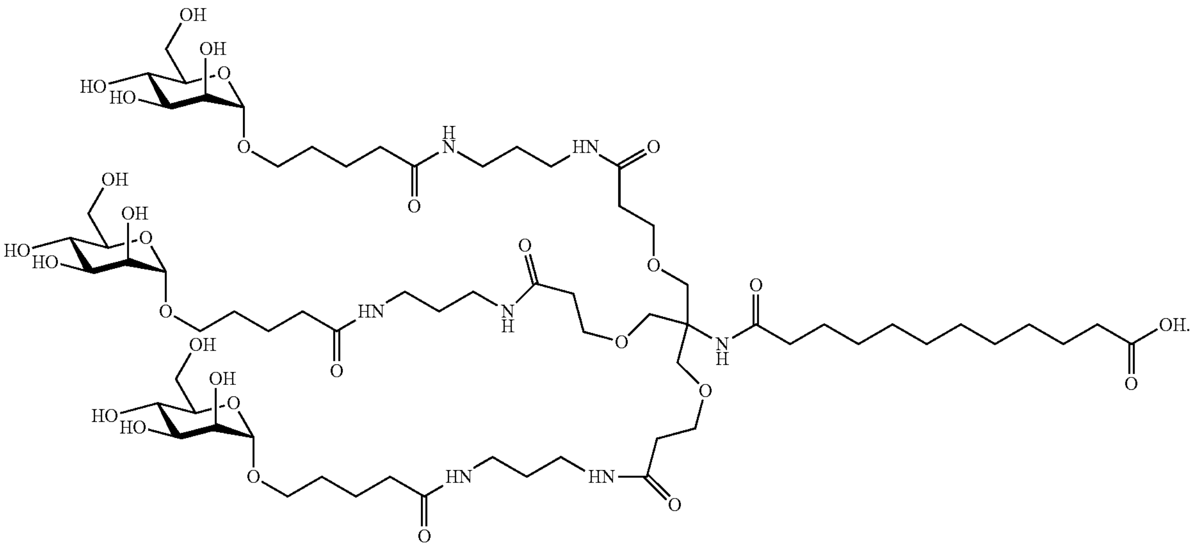

In some embodiments, a provided acid is

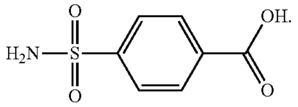 [SMILES: NS(=O)(=O)c1ccc(C(=O)O)cc1]

In some embodiments, a provided acid is

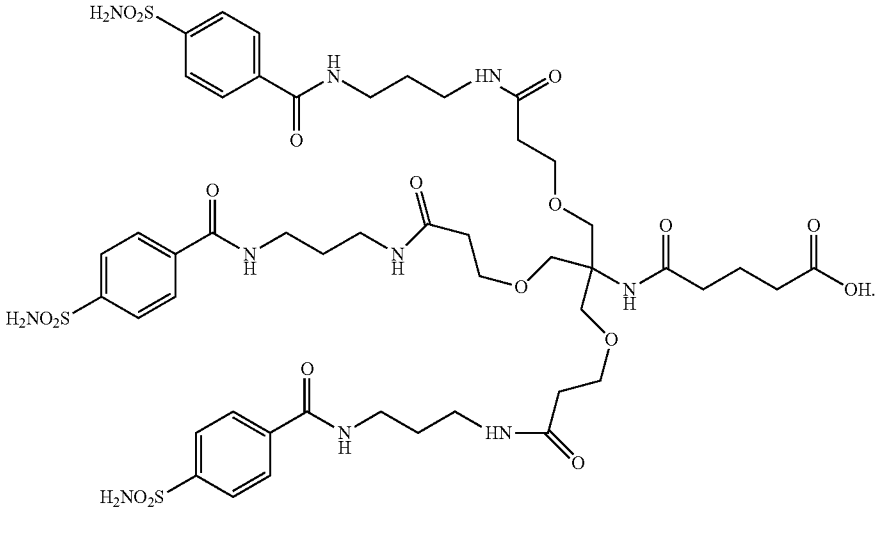 [SMILES: NS(=O)(=O)c1ccc(C(=O)NCCCNC(=O)CCOCC(COCCC(=O)NCCCNC(=O)c2ccc(S(N)(=O)=O)cc2)(COCCC(=O)NCCCNC(=O)c2ccc(S(N)(=O)=O)cc2)NC(=O)CCCC(=O)O)cc1]

pure. In some embodiments, the purity is at least 50%. In some embodiments, the purity is at least 75%. In some embodiments, the purity is at least 80%. In some embodiments, the purity is at least 85%. In some embodiments, the purity is at least 90%. In some embodiments, the purity is at least 95%. In some embodiments, the purity is at least 96%. In some embodiments, the purity is at least 97%. In some embodiments, the purity is at least 98%. In some embodiments, the purity is at least 99%.

In some embodiments, a provided acid is a fatty acid, which can provide a lipid moiety as a targeting component. In some embodiments, the present disclosure provides methods and reagents for preparing such acids.

In some embodiments, provided compounds, e.g., reagents, products (e.g., oligonucleotides, amidites, etc.) etc. are at least 10%, 20%, 30%, 40%, 50%, 60%, 70%, 75%, 80%, 81%, 82%, 83%, 84%, 85%, 86%, 87%, 88%, 89%, 90%, 91%, 92%, 93%, 94%, 95%, 96%, 97%, 97% or 99%

Example Uses

In some embodiments, the present disclosure encompasses the use of a composition comprising a lipid and a biologically active agent. In some embodiments, the present disclosure provides methods for delivering a biologically active agent to a target location comprising administering a provided composition. In some embodiments, a provided method delivers a biologically active agent into a cell. In some embodiments, a provided method delivers a biologically active agent into a muscle cell. In some embodiments, a provided method delivers a biologically active agent into a cell within a tissue. In some embodiments, a provided method delivers a biologically active agent into a cell within an organ. In some embodiments, a provided method delivers a biologically active agent into a cell within a subject, comprising administering to the subject a provided composition. In some embodiments, a provided method delivers a biologically active agent into cytoplasm. In some embodiments, a provided method delivers a biologically active agent into nucleus.

In some embodiments, the present disclosure pertains to methods related to the delivery of a biologically active agent to a muscle cell or tissue, or a muscle cell or tissue in a mammal (e.g., a human subject), which method pertains to a use of a composition comprising a biological agent and a lipid. any one or more additional components selected from: a polynucleotide, a dye, an intercalating agent (e.g. an acridine), a cross-linker (e.g. psoralene, or mitomycin C), a porphyrin (e.g., TPPC4, texaphyrin, or Sapphyrin), a polycyclic aromatic hydrocarbon (e.g., phenazine, or dihydrophenazine), an artificial endonuclease, a chelating agent, EDTA, an alkylating agent, a phosphate, an amino, a mercapto, a PEG (e.g., PEG-40K), MPEG, $[MPEG]_2$, a polyamino, an alkyl, a substituted alkyl, a radiolabeled marker, an enzyme, a hapten (e.g. biotin), a transport/absorption facilitator (e.g., aspirin, vitamin E, or folic acid), a synthetic ribonuclease, a protein, e.g., a glycoprotein, or peptide, e.g., a molecule having a specific affinity for a co-ligand, or antibody e.g., an antibody, a hormone, a hormone receptor, a non-peptidic species, a lipid, a lectin, a carbohydrate, a vitamin, a cofactor, or a drug. In some embodiments, the present disclosure pertains to compositions or methods related to a composition comprising a biologically active agent and a lipid comprising a $C_{10}$-$C_{60}$ linear, saturated or partially unsaturated, aliphatic chain. In some embodiments, the present disclosure pertains to compositions or methods related to a composition comprising a biologically active agent and a lipid comprising a $C_{10}$-$C_{60}$ linear, saturated or partially unsaturated, aliphatic chain, optionally substituted with one or more $C_{1-4}$ aliphatic group. In some embodiments, the present disclosure provides chirally controlled oligonucleotide compositions and a lipid selected from the group consisting of: lauric acid, myristic acid, palmitic acid, stearic acid, oleic acid, linoleic acid, alpha-linolenic acid, gamma-linolenic acid, docosahexaenoic acid (cis-DHA), turbinaric acid and dilinoleyl, wherein the composition is suitable for delivery of the oligonucleotide to a muscle cell or tissue, or a muscle cell or tissue in a mammal (e.g., a human subject). In some embodiments, a biologically active agent is an oligonucleotide comprising one or more chiral internucleotidic linkages, and a provided composition is a chirally controlled oligonucleotide composition of the oligonucleotide. In some embodiments, a biologically active agent is an oligonucleotide comprising one or more chiral internucleotidic linkages, and a provided composition is a non-chirally controlled oligonucleotide composition of the oligonucleotide.

In some embodiments, the present disclosure pertains to a method of delivering a biologically active agent to a cell or tissue, wherein the method comprises steps of: providing a composition comprising a biologically active agent and a lipid; and contacting the cell or tissue with the composition; in some embodiments, the present disclosure pertains to a method of administering a biologically active agent to a subject, wherein the method comprises steps of: providing a composition comprising a biologically active agent and a lipid; and administering the composition to the subject. In some embodiments, a lipid comprises a $C_{10}$-$C_{60}$ linear, saturated or partially unsaturated, aliphatic chain. In some embodiments, a lipid comprises a $C_{10}$-$C_{60}$ linear, saturated or partially unsaturated, aliphatic chain, optionally substituted with one or more $C_{1-4}$ aliphatic group. In various embodiments, the lipid is selected from the group consisting of: lauric acid, myristic acid, palmitic acid, stearic acid, oleic acid, linoleic acid, alpha-linolenic acid, gamma-linolenic acid, docosahexaenoic acid (cis-DHA), turbinaric acid and dilinoleyl. In some embodiments, a biologically active agent is selected from the group consisting of: a small molecule, a peptide, a protein, a component of a CRISPR-Cas system, a carbohydrate, a therapeutic agent, a chemotherapeutic agent, a vaccine, a nucleic acid, and a lipid. In some embodiments, a nucleic acid is an oligonucleotide, an antisense oligonucleotide, an RNAi agent, a miRNA, immunomodulatory nucleic acid, an aptamer, a Piwi-interacting RNA (piRNA), a small nucleolar RNA (snoRNA), a ribozyme, a mRNA, a lncRNA, a ncRNA, an antigomir (e.g., an antagonist to a miRNA, lncRNA, ncRNA or other nucleic acid), a plasmid, a vector, or a portion thereof. In some embodiments, a provided composition is a chirally controlled oligonucleotide composition of a nucleic acid which comprises one or more chiral internucleotidic linkages. In various embodiments, the extra-hepatic cell or tissue is a muscle cell or tissue. In various embodiments, a muscle-related disorder is sarcopenia, a muscle movement disorder, a muscle wasting-related disorder, muscle degeneration, muscle weakness, muscular dystrophy, Duchenne muscular dystrophy, heart failure, breathing disorder, skeletal muscle degeneration caused by malnutrition and disease, a muscle-related disease related to impaired insulin-dependent signaling, amyotrophic lateral sclerosis, spinal muscle atrophy and spinal cord injury, ischemic muscle disease. In some embodiments, the present disclosure pertains to a method of administering a nucleic acid (as a non-limiting example, an oligonucleotide or a stereodefined oligonucleotide) to a muscle cell or tissue in a subject, wherein the subject is afflicted with a muscle-related disease or disorder, wherein the method comprises steps of: providing a composition comprising a lipid and the nucleic acid, and administering a therapeutically effective amount of the composition to the subject.

In some embodiments, a biologically active agent is an oligonucleotide, whose sequence is or comprises an element that is substantially complementary to a targeted element in a cellular nucleic acid. In some embodiments, a targeted element is or comprises a sequence element that is associated with a muscle disease, disorder or condition. In some embodiments, a muscle disease, disorder or condition is DMD. In some embodiments, a cellular nucleic acid is or comprises a transcript. In some embodiments, a cellular nucleic acid is or comprises a primary transcript. In some embodiments, a cellular nucleic acid is or comprises a genomic nucleic acid. The present disclosure encompasses the recognition that certain lipids and other compounds are useful for delivery of biologically active agents to cells and tissues, e.g., in a mammal or human subject. Many technologies for delivering such agents can suffer from an inability to target desired cells or tissues.

Delivery of biologically active agents to tissues outside the liver remains difficult. Juliano reported that, despite advances at the clinical level, effective delivery of oligonucleotides in vivo remains a major challenge, especially at extra-hepatic sites. Juliano 2016 Nucl. Acids Res. Doi: 10.1093/nar/gkw236. Lou also reported that delivery of siRNA to organs beyond the liver remains the biggest hurdle to using the technology for a host of diseases. Lou 2014 SciBX 7(48); doi:10.1038/scibx.2014.1394.

The present disclosure encompasses certain surprising findings, including that certain lipids and other compounds are particularly effective at delivering biologically active agents to particular cells and tissues, including cells and tissues outside the liver, including, as non-limiting examples, muscle cells and tissues.

In some embodiments, provided compositions alter transcript splicing so that an undesired target and/or biological function are suppressed. In some embodiments, in such cases provided composition can also induce cleavage of the transcript after hybridization.

In some embodiments, provided compositions alter transcript splicing so a desired target and/or biological function is enhanced. In some embodiments, provided compositions, by incorporating chemical modifications, stereochemistry and/or combinations thereof, effectively suppress or prevent cleavage of a target transcript after contact.

In some embodiments, each oligonucleotide of a plurality comprises one or more modified sugar moieties and modified internucleotidic linkages. In some embodiments, each oligonucleotide of a plurality comprises two or more modified sugar moieties. In some embodiments, each oligonucleotide of a plurality comprises three or more modified sugar moieties. In some embodiments, each oligonucleotide of a plurality comprises four or more modified sugar moieties. In some embodiments, each oligonucleotide of a plurality comprises five or more modified sugar moieties. In some embodiments, each oligonucleotide of a plurality comprises ten or more modified sugar moieties. In some embodiments, each oligonucleotide of a plurality comprises about 15 or more modified sugar moieties. In some embodiments, each oligonucleotide of a plurality comprises about 20 or more modified sugar moieties. In some embodiments, each oligonucleotide of a plurality comprises about 25 or more modified sugar moieties.

Example Embodiments

In some embodiments, the present disclosure provides the following example embodiments:

1. An oligonucleotide composition comprising a first plurality of oligonucleotides, wherein:
   - oligonucleotides of the first plurality have the same base sequence;
   - oligonucleotides of the first plurality comprise a 5'-end region comprising 2, 3, 4, 5, 6, 7, 8, 9, 10 or more consecutive modified internucleotidic linkages, a 3'-end region comprising 2, 3, 4, 5, 6, 7, 8, 9, 10 or more consecutive modified internucleotidic linkages, and a middle region between the 5'-end region and the 3'-region comprising 1, 2, 3, 4, 5, 6, 7, 8, 9, 10 or more natural phosphate linkages.

2. An oligonucleotide composition comprising a first plurality of oligonucleotides, wherein:
   - oligonucleotides of the first plurality have the same base sequence;
   - oligonucleotides of the first plurality comprise a 5'-end region comprising 2, 3, 4, 5, 6, 7, 8, 9, 10 or more consecutive modified internucleotidic linkages, a 3'-end region comprising 2, 3, 4, 5, 6, 7, 8, 9, 10 or more consecutive modified internucleotidic linkages, and a middle region between the 5'-end region and the 3'-region comprising 1, 2, 3, 4, 5, 6, 7, 8, 9, 10 or more Rp internucleotidic linkages.

3. The composition of any one of the preceding embodiments, wherein the composition comprising a first plurality of oligonucleotides, each of which has the structure of:

$$5'\text{—}[Nu^5]_{z1}\text{—}[Nu^m]_{z2}\text{—}[Nu^3]_{z3}\text{—}3',$$

wherein:
   - each $Nu^5$ is independently a nucleotidic unit, and at least one is $Nu^S$ or $Nu^F$;
   - each $Nu^3$ is independently a nucleotidic unit, and at least one is $Nu^S$ or $Nu^F$;
   - each $Nu^S$ is independently a nucleotidic unit comprising a modified internucleotidic linkage;
   - each $Nu^F$ is independently a nucleotidic unit comprises —F;
   - each of z1, z2 and z3 is independently 0-100, wherein at least one of z1, z2 and z3 is not 0;
   - each $Nu^m$ is independently a nucleotidic unit; and wherein at least 2, 3, 4, 5, 6, 7, 8, 9, 10 consecutive $Nu^5$ and at least 2, 3, 4, 5, 6, 7, 8, 9, 10 consecutive $Nu^3$ are $Nu^S$, and at least 1, 2, 3, 4, 5, 6, 7, 8, 9, 10 $Nu^m$ comprise a natural phosphate linkage or an Rp internucleotidic linkage.

4. The composition of any one of the preceding embodiments, wherein the composition comprising a first plurality of oligonucleotides, each of which has the structure of $5'\text{-}[Nu^S]_{z1}\text{-}[Nu^m]_{z2}\text{-}[Nu^S]_{z3}\text{-}3'$. 5. The composition of any one of the preceding embodiments, wherein the first of the 5'-end consecutive modified internucleotidic linkages is the first internucleotidic linkage of the oligonucleotide.

6. The composition of any one of the preceding embodiments, wherein the last of the 3'-end consecutive modified internucleotidic linkages is the last internucleotidic linkage of the oligonucleotide.

7. The composition of any one of the preceding embodiments, wherein the 5'-end comprises 2 or more consecutive modified internucleotidic linkages.

8. The composition of any one of the preceding embodiments, wherein the 5'-end comprises 3 or more consecutive modified internucleotidic linkages.

9. The composition of any one of the preceding embodiments, wherein the 5'-end comprises 4 or more consecutive modified internucleotidic linkages.

10. The composition of any one of the preceding embodiments, wherein the 5'-end comprises 5 or more consecutive modified internucleotidic linkages.

11. The composition of any one of the preceding embodiments, wherein the 5'-end comprises 6 or more consecutive modified internucleotidic linkages.

12. The composition of any one of the preceding embodiments, wherein the 5'-end comprises 7 or more consecutive modified internucleotidic linkages.

13. The composition of any one of the preceding embodiments, wherein the 5'-end comprises 8 or more consecutive modified internucleotidic linkages.

14. The composition of any one of the preceding embodiments, wherein the 3'-end comprises 2 or more consecutive modified internucleotidic linkages.

15. The composition of any one of the preceding embodiments, wherein the 3'-end comprises 3 or more consecutive modified internucleotidic linkages.

16. The composition of any one of the preceding embodiments, wherein the 5'-end comprises 4 or more consecutive modified internucleotidic linkages.

17. The composition of any one of the preceding embodiments, wherein the 5'-end comprises 5 or more consecutive modified internucleotidic linkages.

18. The composition of any one of the preceding embodiments, wherein the 5'-end comprises 6 or more consecutive modified internucleotidic linkages.

19. The composition of any one of the preceding embodiments, wherein the 5'-end comprises 7 or more consecutive modified internucleotidic linkages.

20. The composition of any one of the preceding embodiments, wherein the 5'-end comprises 8 or more consecutive modified internucleotidic linkages.

21. The composition of any one of the preceding embodiments, wherein each of the 5'- and 3'-end consecutive modified internucleotidic linkages independently has the structure of formula I.

22. The composition of any one of the preceding embodiments, wherein each of the 5'-end consecutive modified internucleotidic linkages is phosphorothioate.

23. The composition of any one of the preceding embodiments, wherein each of the 3'-end consecutive modified internucleotidic linkages is phosphorothioate.

24. The composition of any one of the preceding embodiments, wherein each of the 5'-end consecutive modified internucleotidic linkages is Sp.

25. The composition of any one of the preceding embodiments, wherein each of the 3'-end consecutive modified internucleotidic linkages is Sp.

26. The composition of any one of the preceding embodiments, wherein the middle region comprises 1 or more natural phosphate linkages.

27. The composition of any one of the preceding embodiments, wherein the middle region comprises 2 or more natural phosphate linkages.

28. The composition of any one of the preceding embodiments, wherein the middle region comprises 3 or more natural phosphate linkages.

29. The composition of any one of the preceding embodiments, wherein the middle region comprises 4 or more natural phosphate linkages.

30. The composition of any one of the preceding embodiments, wherein the middle region comprises 5 or more natural phosphate linkages.

31. The composition of any one of the preceding embodiments, wherein the middle region comprises 6 or more natural phosphate linkages.

32. The composition of any one of the preceding embodiments, wherein the middle region comprises 7 or more natural phosphate linkages.

33. The composition of any one of the preceding embodiments, wherein the middle region comprises 8 or more natural phosphate linkages.

34. The composition of any one of the preceding embodiments, wherein the middle region comprises 1 or more Rp internucleotidic linkages.

35. The composition of any one of the preceding embodiments, wherein the middle region comprises 2 or more Rp internucleotidic linkages.

36. The composition of any one of the preceding embodiments, wherein the middle region comprises 3 or more Rp internucleotidic linkages.

37. The composition of any one of the preceding embodiments, wherein the middle region comprises 4 or more Rp internucleotidic linkages.

38. The composition of any one of the preceding embodiments, wherein the middle region comprises 5 or more Rp internucleotidic linkages.

39. The composition of any one of the preceding embodiments, wherein the middle region comprises 6 or more Rp internucleotidic linkages.

40. The composition of any one of the preceding embodiments, wherein the middle region comprises 7 or more Rp internucleotidic linkages.

41. The composition of any one of the preceding embodiments, wherein the middle region comprises 8 or more Rp internucleotidic linkages.

42. The composition of any one of the preceding embodiments, wherein the middle region comprises 1 or more Sp internucleotidic linkages.

43. The composition of any one of the preceding embodiments, wherein the middle region comprises 2 or more Sp internucleotidic linkages.

44. The composition of any one of the preceding embodiments, wherein the middle region comprises 3 or more Sp internucleotidic linkages.

45. The composition of any one of the preceding embodiments, wherein the middle region comprises 4 or more Sp internucleotidic linkages.

46. The composition of any one of the preceding embodiments, wherein the middle region comprises 5 or more Sp internucleotidic linkages.

47. The composition of any one of the preceding embodiments, wherein the middle region comprises 6 or more Sp internucleotidic linkages.

48. The composition of any one of the preceding embodiments, wherein the middle region comprises 7 or more Sp internucleotidic linkages.

49. The composition of any one of the preceding embodiments, wherein the middle region comprises 8 or more Sp internucleotidic linkages.

50. The composition of any one of the preceding embodiments, wherein each oligonucleotide of the first plurality independently comprises a nucleotidic unit comprising —F.

51. The composition of any one of the preceding embodiments, wherein each oligonucleotide of the first plurality comprises 1 or more nucleoside units comprising —F.

52. The composition of any one of the preceding embodiments, wherein each oligonucleotide of the first plurality comprises 2 or more nucleoside units comprising —F.

53. The composition of any one of the preceding embodiments, wherein each oligonucleotide of the first plurality comprises 3 or more nucleoside units comprising —F.

54. The composition of any one of the preceding embodiments, wherein each oligonucleotide of the first plurality comprises 4 or more nucleoside units comprising —F.

55. The composition of any one of the preceding embodiments, wherein each oligonucleotide of the first plurality comprises 5 or more nucleoside units comprising —F.

56. The composition of any one of the preceding embodiments, wherein each oligonucleotide of the first plurality comprises 6 or more nucleoside units comprising —F.

57. The composition of any one of the preceding embodiments, wherein each oligonucleotide of the first plurality comprises 8 or more nucleoside units comprising —F.

58. The composition of any one of the preceding embodiments, wherein each oligonucleotide of the first plurality comprises 9 or more nucleoside units comprising —F.

59. The composition of any one of the preceding embodiments, wherein each oligonucleotide of the first plurality comprises 10 or more nucleoside units comprising —F.

60. The composition of any one of the preceding embodiments, wherein a nucleotidic unit comprising a 5'-end consecutive modified internucleotidic linkage comprises a nucleoside unit comprising —F.

61. The composition of any one of the preceding embodiments, wherein each nucleotidic unit comprising a 5'-end consecutive modified internucleotidic linkage independently comprises a nucleoside unit comprising —F.

62. The composition of any one of the preceding embodiments, wherein a nucleotidic unit comprising a 3'-end consecutive modified internucleotidic linkage comprises a nucleoside unit comprising —F.

63. The composition of any one of the preceding embodiments, wherein each nucleotidic unit comprising a 3'-end consecutive modified internucleotidic linkage independently comprises a nucleoside unit comprising —F.

64. The composition of any one of the preceding embodiments, wherein the middle region comprises one or more nucleotidic units comprising a nucleoside units comprising —F.

65. The composition of embodiment 64, wherein one or more of the nucleotidic units comprises a natural phosphate linkage.

66. The composition of embodiment 64 or 65, wherein one or more of the nucleotidic units comprises a modified internucleotidic linkage.

67. An oligonucleotide composition comprising a first plurality of oligonucleotides, wherein:

oligonucleotides of the first plurality have the same base sequence;

oligonucleotides of the first plurality comprise one or more nucleoside units comprising —F.

68. The composition of embodiment 67, wherein the composition comprising a first plurality of oligonucleotides, each of which has the structure of:

$$5'\text{-}[Nu^5]_{z1}\text{-}[Nu^m]_{z2}\text{-}[Nu^3]_{z3}\text{-}3',$$

wherein:

each $Nu^5$ is independently a nucleotidic unit, and at least one is $Nu^S$ or $Nu^F$;

each $Nu^3$ is independently a nucleotidic unit, and at least one is $Nu^S$ or $Nu^F$;

each $Nu^S$ is independently a nucleotidic unit comprising a modified internucleotidic linkage;

each $Nu^F$ is independently a nucleotidic unit comprises —F;

each of z1, z2 and z3 is independently 0-100, wherein at least one of z1, z2 and z3 is not 0;

each $Nu^m$ is independently a nucleotidic unit; and wherein at least one of $Nu^5$, $Nu^3$, and $Nu^m$ is $Nu^F$.

69. The composition of embodiment 68, wherein at least one $Nu^5$ and at least one $Nu^3$ is $Nu^F$.

70. The composition of any one of embodiments 67-69, wherein the composition comprising a first plurality of oligonucleotides, each of which has the structure of $5'\text{-}[Nu^F]_{z1}\text{-}[Nu^m]_{z2}\text{-}[Nu^F]_{z3}\text{-}3$.

71. The composition of any one of the preceding embodiments, wherein each $Nu^S$ independently comprises a modified internucleotidic linkage having the structure of formula I.

72. The composition of any one of the preceding embodiments, wherein each $Nu^S$ comprises a phosphorothioate linkage.

73. The composition of any one of the preceding embodiments, wherein each $Nu^F$ comprises a chirally controlled modified internucleotidic linkage.

74. The composition of any one of the preceding embodiments, wherein each $Nu^F$ comprises a chirally controlled Sp modified internucleotidic linkage.

75. The composition of any one of the preceding embodiments, wherein each $Nu^S$ comprises a modified sugar moiety.

76. The composition of any one of the preceding embodiments, wherein each $Nu^S$ comprises a 2'-F sugar moiety.

77. The composition of any one of the preceding embodiments, wherein each $Nu^F$ comprises a 2'-F sugar moiety.

78. The composition of any one of the preceding embodiments, wherein each $Nu^F$ comprises a modified internucleotidic linkage of formula I.

79. The composition of any one of the preceding embodiments, wherein each $Nu^F$ comprises a phosphorothioate linkage.

80. The composition of any one of the preceding embodiments, wherein each $Nu^F$ comprises a chirally controlled modified internucleotidic linkage.

81. The composition of any one of the preceding embodiments, wherein each $Nu^F$ comprises a chirally controlled Sp modified internucleotidic linkage.

82. The composition of any one of the preceding embodiments, wherein at least one $Nu^m$ comprises a 2'-F modified sugar moiety.

83. The composition of any one of the preceding embodiments, wherein at least one $Nu^m$ comprises a 2'-$OR^1$ modified sugar moiety, wherein $R^1$ is optionally substituted $C_{1-6}$ alkyl.

84. The composition of any one of the preceding embodiments, wherein at least one $Nu^m$ comprises a natural phosphate linkage.

85. The composition of any one of the preceding embodiments, wherein at least one $Nu^m$ comprises a modified internucleotidic linkage.

86. The composition of any one of the preceding embodiments, wherein at least one $Nu^m$ comprises a chirally controlled Sp modified internucleotidic linkage.

87. The composition of any one of the preceding embodiments, wherein at least one $Nu^m$ comprises a chirally controlled Rp modified internucleotidic linkage.

88. The composition of any one of the preceding embodiments, wherein at least one $Nu^m$ comprises a 2'-$OR^1$ modified sugar moiety, wherein $R^1$ is optionally substituted $C_{1-6}$ alkyl, and a natural phosphate linkage.

89. The composition of any one of the preceding embodiments, wherein at least one $Nu^m$ comprises a 2'-F modified sugar moiety, and a modified internucleotidic linkage.

90. The composition of any one of the preceding embodiments, wherein at least one $Nu^m$ comprises a 2'-F modified sugar moiety, and a chirally controlled Sp modified internucleotidic linkage.

91. The composition of any one of the preceding embodiments, wherein at least one $Nu^m$ comprises a 2'-F modified sugar moiety, and a chirally controlled Rp modified internucleotidic linkage.

92. The composition of any one of the preceding embodiments, wherein each of $Nu^S$, $Nu^F$ and $Nu^m$ independently has the structure of:

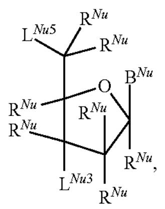

wherein:

$B^{Nu}$ is an optionally substituted nucleobase;

each $R^{Nu}$ is independently $R^1$, R', -L-$R^1$, or -L-R', wherein each of $R^1$, R', and L is independently as defined and described;

$L^{Nu5}$ is a covalent bond, or if at the 5'-end of an oligonucleotide, $R^{Nu}$; and $L^{Nu3}$ is a internucleotidic linkage having the structure of formula I, or if at the 3'-end of an oligonucleotide, $R^{Nu}$.

93. The composition of any one of the preceding embodiments, wherein each of $Nu^S$, $Nu^F$ and $Nu^m$ independently has the structure of:

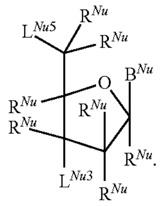

94. The composition of any one of the preceding embodiments, wherein $B^{Nu}$ is optionally substituted A, T, C, G and U; 95. The composition of any one of the preceding embodiments, wherein in 1, 2, 3, 4, 5, 6, 7, 8, 9, 10 or more of $Nu^S$, $Nu^F$ and $Nu^m$, two $R^{Nu}$ groups are taken together with their intervening atoms to form a ring system.

96. The composition of any one of the preceding embodiments, wherein in 1, 2, 3, 4, 5, 6, 7, 8, 9, 10 or more of $Nu^S$, $Nu^F$ and $Nu^m$, the 2'-$R^{Nu}$ is 2'-$OR^1$.

97. The composition of any one of the preceding embodiments, wherein in 1, 2, 3, 4, 5, 6, 7, 8, 9, 10 or more of $Nu^S$, $Nu^F$ and $Nu^m$, the 2'-$R^{Nu}$ is 2'-F.

98. The composition of any one of the preceding embodiments, wherein $L^{Nu5}$ is 5'-OH, protected 5'-OH, or —O—, or a covalent bond.

99. The composition of any one of the preceding embodiments, wherein $L^{Nu3}$ has the structure of formula I, 3'-OH or protected 3'-OH.

100. The composition of any one of the preceding embodiments, wherein the sum of z1, z2 and z3 are 10, 11, 12, 13, 14, 15, 16, 17, 18, 19, 20, 21, 22, 23, 24, 25, 26, 27, 28, 29, 30, 35, 40, 50 or more.

101. The composition of any one of the preceding embodiments, wherein z1 is 4 or more.

102. The composition of any one of the preceding embodiments, wherein z1 is 5 or more.

103. The composition of any one of the preceding embodiments, wherein z1 is 6 or more.

104. The composition of any one of the preceding embodiments, wherein z2 is 4 or more.

105. The composition of any one of the preceding embodiments, wherein z2 is 5 or more.

106. The composition of any one of the preceding embodiments, wherein z2 is 6 or more.

107. The composition of any one of the preceding embodiments, wherein z3 is 4 or more.

108. The composition of any one of the preceding embodiments, wherein z3 is 5 or more.

109. The composition of any one of the preceding embodiments, wherein z3 is 6 or more.

110. The composition of any one of the preceding embodiments, wherein z1 equals z3.

111. The composition of any one of the preceding embodiments, wherein $[Nu^5]_{z1}$, $[Nu^S]_{z1}$, or $[Nu^F]_{z1}$ is a 5'-wing or a 5'-end region.

112. The composition of any one of the preceding embodiments, wherein $[Nu^5]_{z3}$, $[Nu^S]_{z3}$, or $[Nu^F]_{z3}$ is a 3'-wing or a 3'-end region.

113. The composition of any one of the preceding embodiments, wherein $[Nu^m]_{z2}$ is a core or a middle region.

114. The composition of any one of the preceding embodiments, wherein oligonucleotides of the first plurality comprise 2 or more nucleoside units comprising —F.

115. The composition of any one of the preceding embodiments, wherein oligonucleotides of the first plurality comprise 3 or more nucleoside units comprising —F.

116. The composition of any one of the preceding embodiments, wherein oligonucleotides of the first plurality comprise 4 or more nucleoside units comprising —F.

117. The composition of any one of the preceding embodiments, wherein oligonucleotides of the first plurality comprise 5 or more nucleoside units comprising —F.

118. The composition of any one of the preceding embodiments, wherein oligonucleotides of the first plurality comprise 6 or more nucleoside units comprising —F.

119. The composition of any one of the preceding embodiments, wherein oligonucleotides of the first plurality comprise 7 or more nucleoside units comprising —F.

120. The composition of any one of the preceding embodiments, wherein oligonucleotides of the first plurality comprise 8 or more nucleoside units comprising —F.

121. The composition of any one of the preceding embodiments, wherein oligonucleotides of the first plurality comprise 9 or more nucleoside units comprising —F.

122. The composition of any one of the preceding embodiments, wherein oligonucleotides of the first plurality comprise 10 or more nucleoside units comprising —F.

123. The composition of any one of the preceding embodiments, wherein each of the first plurality of oligonucleotides comprises a 5'-end region comprising 1, 2, 3, 4, 5, 6, 7, 8, 9, 10 or more nucleoside units comprising —F.

124. The composition of any one of the preceding embodiments, wherein each of the first plurality of oligonucleotides comprises a 5'-end region comprising 2 or more nucleoside units comprising —F.

125. The composition of any one of the preceding embodiments, wherein each of the first plurality of oligonucleotides comprises a 5'-end region comprising 3 or more nucleoside units comprising —F.

126. The composition of any one of the preceding embodiments, wherein each of the first plurality of oligonucleotides comprises a 5'-end region comprising 4 or more nucleoside units comprising —F.

127. The composition of any one of the preceding embodiments, wherein each of the first plurality of oligonucleotides comprises a 5'-end region comprising 5 or more nucleoside units comprising —F.

128. The composition of any one of the preceding embodiments, wherein each of the first plurality of oligonucleotides comprises a 5'-end region comprising 6 or more nucleoside units comprising —F.

129. The composition of any one of the preceding embodiments, wherein each of the first plurality of oligonucleotides comprises a 5'-end region comprising 7 or more nucleoside units comprising —F.

130. The composition of any one of the preceding embodiments, wherein each of the first plurality of oligonucleotides comprises a 5'-end region comprising 8 or more nucleoside units comprising —F.

131. The composition of any one of the preceding embodiments, wherein the first nucleoside unit of the 5'-end consecutive nucleoside units is the first nucleoside unit of the oligonucleotide.

132. The composition of any one of the preceding embodiments, wherein each of the first plurality of oligonucleotides comprises a 3'-end region comprising 1, 2, 3, 4, 5, 6, 7, 8, 9, 10 or more nucleoside units each comprising —F.

133. The composition of any one of the preceding embodiments, wherein each of the first plurality of oligonucleotides comprises a 3'-end region comprising 2 or more nucleoside units comprising —F.

134. The composition of any one of the preceding embodiments, wherein each of the first plurality of oligonucleotides comprises a 3'-end region comprising 3 or more nucleoside units comprising —F.

135. The composition of any one of the preceding embodiments, wherein each of the first plurality of oligonucleotides comprises a 3'-end region comprising 4 or more nucleoside units comprising —F.

136. The composition of any one of the preceding embodiments, wherein each of the first plurality of oligonucleotides comprises a 3'-end region comprising 5 or more nucleoside units comprising —F.

137. The composition of any one of the preceding embodiments, wherein each of the first plurality of oligonucleotides comprises a 3'-end region comprising 6 or more nucleoside units comprising —F.

138. The composition of any one of the preceding embodiments, wherein each of the first plurality of oligonucleotides comprises a 3'-end region comprising 7 or more nucleoside units comprising —F.

139. The composition of any one of the preceding embodiments, wherein each of the first plurality of oligonucleotides comprises a 3'-end region comprising 8 or more nucleoside units comprising —F.

140. The composition of any one of the preceding embodiments, wherein the last nucleoside unit of the 3'-end consecutive nucleoside units is the last nucleoside unit of the oligonucleotide.

141. The composition of any one of the preceding embodiments, wherein the nucleoside units comprising —F are consecutive.

142. The composition of any one of the preceding embodiments, wherein the nucleoside unit comprising —F comprises 2'-F modified sugar moieties.

143. The composition of any one of the preceding embodiments, wherein a nucleotide unit comprising —F comprises a modified internucleotidic linkage.

144. The composition of any one of the preceding embodiments, wherein each nucleotide unit comprising —F, if it comprises an internucleotidic linkage, comprises a modified internucleotidic linkage.

145. The composition of any one of embodiments 143-144, wherein the modified internucleotidic linkage is chiral.

146. The composition of any one of embodiments 143-144, wherein the modified internucleotidic linkage is chirally controlled.

147. The composition of any one of embodiments 143-146, wherein the modified internucleotidic linkage is a phosphorothioate linkage.

148. The composition of any one of the preceding embodiments, wherein oligonucleotides of the first plurality comprise 2 or more modified internucleotidic linkages.

149. The composition of any one of the preceding embodiments, wherein oligonucleotides of the first plurality comprise 3 or more modified internucleotidic linkages.

150. The composition of any one of the preceding embodiments, wherein oligonucleotides of the first plurality comprise 4 or more modified internucleotidic linkages.

151. The composition of any one of the preceding embodiments, wherein oligonucleotides of the first plurality comprise 5 or more modified internucleotidic linkages.

152. The composition of any one of the preceding embodiments, wherein oligonucleotides of the first plurality comprise 6 or more modified internucleotidic linkages.

153. The composition of any one of the preceding embodiments, wherein oligonucleotides of the first plurality comprise 7 or more modified internucleotidic linkages.

154. The composition of any one of the preceding embodiments, wherein oligonucleotides of the first plurality comprise 8 or more modified internucleotidic linkages.

155. The composition of any one of the preceding embodiments, wherein oligonucleotides of the first plurality comprise 9 or more modified internucleotidic linkages.

156. The composition of any one of the preceding embodiments, wherein oligonucleotides of the first plurality comprise 10 or more modified internucleotidic linkages.

157. The composition of any one of the preceding embodiments, wherein oligonucleotides of the first plurality comprise 11 or more modified internucleotidic linkages.

158. The composition of any one of the preceding embodiments, wherein oligonucleotides of the first plurality comprise 12 or more modified internucleotidic linkages.

159. The composition of any one of the preceding embodiments, wherein oligonucleotides of the first plurality comprise 13 or more modified internucleotidic linkages.

160. The composition of any one of the preceding embodiments, wherein oligonucleotides of the first plurality comprise 14 or more modified internucleotidic linkages.

161. The composition of any one of the preceding embodiments, wherein oligonucleotides of the first plurality comprise 15 or more modified internucleotidic linkages.

162. The composition of any one of the preceding embodiments, wherein oligonucleotides of the first plurality comprise 16 or more modified internucleotidic linkages.

163. The composition of any one of the preceding embodiments, wherein oligonucleotides of the first plurality comprise 17 or more modified internucleotidic linkages.

164. The composition of any one of the preceding embodiments, wherein oligonucleotides of the first plurality comprise 18 or more modified internucleotidic linkages.

165. The composition of any one of the preceding embodiments, wherein oligonucleotides of the first plurality comprise 19 or more modified internucleotidic linkages.

166. The composition of any one of the preceding embodiments, wherein oligonucleotides of the first plurality comprise 20 or more modified internucleotidic linkages.

167. The composition of any one of the preceding embodiments, wherein oligonucleotides of the first plurality comprise 2 or more natural phosphate linkages.

168. The composition of any one of the preceding embodiments, wherein oligonucleotides of the first plurality comprise 3 or more natural phosphate linkages.

169. The composition of any one of the preceding embodiments, wherein oligonucleotides of the first plurality comprise 4 or more natural phosphate linkages.

170. The composition of any one of the preceding embodiments, wherein oligonucleotides of the first plurality comprise 5 or more natural phosphate linkages.

171. The composition of any one of the preceding embodiments, wherein oligonucleotides of the first plurality comprise 6 or more natural phosphate linkages.

172. The composition of any one of the preceding embodiments, wherein each modified internucleotidic linkage independently has the structure of formula I.

173. The composition of any one of the preceding embodiments, wherein each modified internucleotidic linkage is a phosphorothioate linkage.

174. The composition of any one of the preceding embodiments, wherein each chiral modified internucleotidic linkage of the first plurality of oligonucleotides is independently chirally controlled.

175. The composition of any one of the preceding embodiments, wherein the composition is chirally controlled in that oligonucleotides of the first plurality are of the same oligonucleotide type defined by:

1) base sequence;
2) pattern of backbone linkages;
3) pattern of backbone chiral centers; and
4) pattern of backbone phosphorus modifications.

176. The composition of any one of the preceding embodiments, wherein the oligonucleotides comprise one or more 2'-$OR^1$ sugar modifications.

177. The composition of any one of the preceding embodiments, wherein the oligonucleotides comprise two or more 2'-$OR^1$ sugar modifications.

178. The composition of any one of the preceding embodiments, wherein the oligonucleotides comprise three or more 2'-$OR^1$ sugar modifications.

179. The composition of any one of the preceding embodiments, wherein the oligonucleotides comprise four or more 2'-$OR^1$ sugar modifications.

180. The composition of any one of the preceding embodiments, wherein the oligonucleotides comprise five or more 2'-$OR^1$ sugar modifications.

181. The composition of any one of embodiments 176 to 180, wherein $R^1$ is optionally substituted $C_{1-6}$ aliphatic.

182. The composition of any one of embodiments 176 to 180, wherein $R^1$ is methyl.

183. The composition of any one of embodiments 176 to 182, wherein a nucleotidic unit comprising the 2'-$OR^1$ sugar modifications has a natural phosphate linkage.

184. The composition of any one of embodiments 176 to 183, wherein each nucleotidic unit comprising the 2'-$OR^1$ sugar modifications has a natural phosphate linkage.

185. The composition of any one of the preceding embodiments, wherein the oligonucleotides hybridize with a target sequence in a transcript.

186. The composition of any one of the preceding embodiments, wherein the base sequence is complementary to a target sequence in a transcript.

187. The composition of any one of the preceding embodiments, wherein the oligonucleotide composition is characterized in that, when it is contacted with the transcript in a transcript splicing system, splicing of the transcript is altered relative to that observed under reference conditions selected from the group consisting of absence of the composition, presence of a reference composition, and combinations thereof.

188. An oligonucleotide composition comprising a first plurality of oligonucleotides which:

1) have a common base sequence complementary to a target sequence in a transcript; and
2) comprise one or more modified sugar moieties and modified internucleotidic linkages, the oligonucleotide composition being characterized in that, when it is contacted with the transcript in a transcript splicing system, splicing of the transcript is altered relative to that observed under reference conditions selected from the group consisting of absence of the composition, presence of a reference composition, and combinations thereof.

189. An oligonucleotide composition, comprising a first plurality of oligonucleotides of a particular oligonucleotide type defined by:

1) base sequence;
2) pattern of backbone linkages;
3) pattern of backbone chiral centers; and
4) pattern of backbone phosphorus modifications, which composition is chirally controlled in that it is enriched, relative to a substantially racemic preparation of oligonucleotides having the same base sequence, for oligonucleotides of the particular oligonucleotide type, wherein:

the oligonucleotide composition being characterized in that, when it is contacted with the transcript in a transcript splicing system, splicing of the transcript is altered relative to that observed under reference conditions selected from the group consisting of absence of the composition, presence of a reference composition, and combinations thereof.

190. The oligonucleotide composition of embodiment 188 or 189, wherein the level of the first plurality of oligonucleotides is predetermined.

191. An oligonucleotide composition of embodiment 2, wherein each oligonucleotide of the first plurality comprises one or more modified sugar moieties and modified internucleotidic linkages.

192. The composition of any one of the preceding embodiments, wherein each oligonucleotide of the first plurality comprises two or more modified sugar moieties.

193. The composition of any one of the preceding embodiments, wherein each oligonucleotide of the first plurality comprises three or more modified sugar moieties.

194. The composition of any one of the preceding embodiments, wherein each oligonucleotide of the first plurality comprises four or more modified sugar moieties.

195. The composition of any one of the preceding embodiments, wherein each oligonucleotide of the first plurality comprises five or more modified sugar moieties.

196. The composition of any one of the preceding embodiments, wherein each oligonucleotide of the first plurality comprises ten or more modified sugar moieties.

197. The composition of any one of the preceding embodiments, wherein each oligonucleotide of the first plurality comprises about 15 or more modified sugar moieties.

198. The composition of any one of the preceding embodiments, wherein each oligonucleotide of the first plurality comprises about 20 or more modified sugar moieties.

199. The composition of any one of the preceding embodiments, wherein each oligonucleotide of the first plurality comprises about 25 or more modified sugar moieties.

200. The composition of any one of the preceding embodiments, wherein about 5% or more of the sugar moieties in each oligonucleotide of the first plurality are modified sugar moieties.

201. The composition of any one of the preceding embodiments, wherein about 10% or more of the sugar moieties in each oligonucleotide of the first plurality are modified sugar moieties.

202. The composition of any one of the preceding embodiments, wherein about 20% or more of the sugar moieties in each oligonucleotide of the first plurality are modified sugar moieties.

203. The composition of any one of the preceding embodiments, wherein about 30% or more of the sugar moieties in each oligonucleotide of the first plurality are modified sugar moieties.

204. The composition of any one of the preceding embodiments, wherein about 40% or more of the sugar moieties in each oligonucleotide of the first plurality are modified sugar moieties.

205. The composition of any one of the preceding embodiments, wherein about 50% or more of the sugar moieties in each oligonucleotide of the first plurality are modified sugar moieties.

206. The composition of any one of the preceding embodiments, wherein about 60% or more of the sugar moieties in each oligonucleotide of the first plurality are modified sugar moieties.

207. The composition of any one of the preceding embodiments, wherein about 70% or more of the sugar moieties in each oligonucleotide of the first plurality are modified sugar moieties.

208. The composition of any one of the preceding embodiments, wherein about 80% or more of the sugar moieties in each oligonucleotide of the first plurality are modified sugar moieties.

209. The composition of any one of the preceding embodiments, wherein about 85% or more of the sugar moieties in each oligonucleotide of the first plurality are modified sugar moieties.

210. The composition of any one of the preceding embodiments, wherein about 90% or more of the sugar moieties in each oligonucleotide of the first plurality are modified sugar moieties.

211. The composition of any one of the preceding embodiments, wherein about 95% or more of the sugar moieties in each oligonucleotide of the first plurality are modified sugar moieties.

212. The composition of any one of the preceding embodiments, wherein each oligonucleotide of the first plurality comprises no more than about 25 consecutive unmodified sugar moieties.

213. The composition of any one of the preceding embodiments, wherein each oligonucleotide of the first plurality comprises no more than about 20 consecutive unmodified sugar moieties.

214. The composition of any one of the preceding embodiments, wherein each oligonucleotide of the first plurality comprises no more than about 15 consecutive unmodified sugar moieties.

215. The composition of any one of the preceding embodiments, wherein each oligonucleotide of the first plurality comprises no more than about 10 consecutive unmodified sugar moieties.

216. The composition of any one of the preceding embodiments, wherein each oligonucleotide of the first plurality comprises no more than about 9 consecutive unmodified sugar moieties.

217. The composition of any one of the preceding embodiments, wherein each oligonucleotide of the first plurality comprises no more than about 8 consecutive unmodified sugar moieties.

218. The composition of any one of the preceding embodiments, wherein each oligonucleotide of the first plurality comprises no more than about 7 consecutive unmodified sugar moieties.

219. The composition of any one of the preceding embodiments, wherein each oligonucleotide of the first plurality comprises no more than about 6 consecutive unmodified sugar moieties.

220. The composition of any one of the preceding embodiments, wherein each oligonucleotide of the first plurality comprises no more than about 5 consecutive unmodified sugar moieties.

221. The composition of any one of the preceding embodiments, wherein each oligonucleotide of the first plurality comprises no more than about 4 consecutive unmodified sugar moieties.

222. The composition of any one of the preceding embodiments, wherein each oligonucleotide of the first plurality comprises no more than about 3 consecutive unmodified sugar moieties.

223. The composition of any one of the preceding embodiments, wherein each oligonucleotide of the first plurality comprises no more than about 2 consecutive unmodified sugar moieties.

224. The composition of any one of the preceding embodiments, wherein each oligonucleotide of the first plurality comprises no more than about 25 unmodified sugar moieties.

225. The composition of any one of the preceding embodiments, wherein each oligonucleotide of the first plurality comprises no more than about 20 unmodified sugar moieties.

226. The composition of any one of the preceding embodiments, wherein each oligonucleotide of the first plurality comprises no more than about 15 unmodified sugar moieties.

227. The composition of any one of the preceding embodiments, wherein each oligonucleotide of the first plurality comprises no more than about 10 unmodified sugar moieties.

228. The composition of any one of the preceding embodiments, wherein each oligonucleotide of the first plurality comprises no more than about 5 unmodified sugar moieties.

229. The composition of any one of the preceding embodiments, wherein each oligonucleotide of the first plurality comprises no more than about 95% unmodified sugar moieties.

230. The composition of any one of the preceding embodiments, wherein each oligonucleotide of the first plurality comprises no more than about 90% unmodified sugar moieties.

231. The composition of any one of the preceding embodiments, wherein each oligonucleotide of the first plurality comprises no more than about 85% unmodified sugar moieties.

232. The composition of any one of the preceding embodiments, wherein each oligonucleotide of the first plurality comprises no more than about 80% unmodified sugar moieties.

233. The composition of any one of the preceding embodiments, wherein each oligonucleotide of the first plurality comprises no more than about 70% unmodified sugar moieties.

234. The composition of any one of the preceding embodiments, wherein each oligonucleotide of the first plurality comprises no more than about 60% unmodified sugar moieties.

235. The composition of any one of the preceding embodiments, wherein each oligonucleotide of the first plurality comprises no more than about 50% unmodified sugar moieties.

236. The composition of any one of the preceding embodiments, wherein each oligonucleotide of the first plurality comprises no more than about 40% unmodified sugar moieties.

237. The composition of any one of the preceding embodiments, wherein each oligonucleotide of the first plurality comprises no more than about 30% unmodified sugar moieties.

238. The composition of any one of the preceding embodiments, wherein each oligonucleotide of the first plurality comprises no more than about 20% unmodified sugar moieties.

239. The composition of any one of the preceding embodiments, wherein each oligonucleotide of the first plurality comprises no more than about 10% unmodified sugar moieties.

240. The composition of any one of the preceding embodiments, wherein each oligonucleotide of the first plurality comprises no more than about 5% unmodified sugar moieties.

241. The composition of any one of the preceding embodiments, wherein a modified sugar moiety comprises a bicyclic sugar modification.

242. The composition of any one of the preceding embodiments, wherein a modified sugar moiety comprises a bicyclic sugar modification having a -L- or —O-L- bridge connecting two ring carbon atoms.

243. The composition of any one of the preceding embodiments, wherein a modified sugar moiety comprises a bicyclic sugar modification having a 4'-$CH(CH_3)$—O-2' bridge.

244. The composition of any one of the preceding embodiments, wherein a modified sugar moiety comprises a morpholino moiety.

245. The composition of any one of the preceding embodiments, wherein an oligonucleotide of a first plurality is a morpholino oligonucleotide.

246. The composition of any one of embodiments 1-243, wherein a modified sugar moiety has a 2'-modification.

247. The composition of any one of embodiments 1-243, wherein a modified sugar moiety comprises a 2'-modification, wherein a 2'-modification is 2'-$OR^1$.

248. The composition of any one of embodiments 1-243, wherein a modified sugar moiety comprises a 2'-modification, wherein a 2'-modification is 2'-$OR^1$, wherein $R^1$ is optionally substituted $C_{1-6}$ alkyl.

249. The composition of any one of embodiments 1-243, wherein a modified sugar moiety comprises a 2'-modification, wherein a 2'-modification is 2'-MOE.

250. The composition of any one of embodiments 1-243, wherein a modified sugar moiety comprises a 2'-modification, wherein a 2'-modification is 2'-OMe.

251. The composition of any one of embodiments 1-243, wherein a modified sugar moiety comprises a 2'-modification, wherein the 2'-modification is S-cEt.

252. The composition of any one of embodiments 1-243, wherein a modified sugar moiety comprises a 2'-modification, wherein the 2'-modification is FANA.

253. The composition of any one of embodiments 1-243, wherein a modified sugar moiety comprises a 2'-modification, wherein the 2'-modification is FRNA.

254. The composition of any one of embodiments 1-243, wherein a modified sugar moiety comprises a 2'-modification, wherein the 2'-modification is 2'-F.

255. The composition of any one of embodiments 1-243, wherein a modified sugar moiety comprises a 2'-modification, and the 2'-modification is 2'-$OR^1$ or 2'-F, wherein $R^1$ is not hydrogen.

256. The composition of any one of embodiments 1-243, wherein a modified sugar moiety comprises a 2'-modification, and the 2'-modification is 2'-$OR^1$ or 2'-F, wherein $R^1$ is not optionally substituted $C_{1-6}$ alkyl.

257. The composition of any one of embodiments 255-256, wherein the 2'-$OR^1$ is 2'-OMe.

258. The composition of any one of embodiments 255-257, wherein the 2'-modification is 2'-F.

259. The composition of any one of the preceding embodiments, wherein each oligonucleotide of the first plurality comprises two or more of the sugar modifications.

260. The composition of any one of the preceding embodiments, wherein each oligonucleotide of the first plurality comprises three or more of the sugar modifications.

261. The composition of any one of the preceding embodiments, wherein the sugar modifications are consecutive.

262. The composition of any one of the preceding embodiments, wherein each sugar moiety of the oligonucleotides of the first plurality is independently modified.

263. The composition of any one of the preceding embodiments, wherein each oligonucleotide of the first plurality comprises two or more modified internucleotidic linkages.

264. The composition of any one of the preceding embodiments, wherein each oligonucleotide of the first plurality comprises three or more modified internucleotidic linkages.

265. The composition of any one of the preceding embodiments, wherein each oligonucleotide of the first plurality comprises four or more modified internucleotidic linkages.

266. The composition of any one of the preceding embodiments, wherein each oligonucleotide of the first plurality comprises five or more modified internucleotidic linkages.

267. The composition of any one of the preceding embodiments, wherein each oligonucleotide of the first plurality comprises ten or more modified internucleotidic linkages.

268. The composition of any one of the preceding embodiments, wherein each oligonucleotide of the first plurality comprises about 15 or more modified internucleotidic linkages.

269. The composition of any one of the preceding embodiments, wherein each oligonucleotide of the first plurality comprises about 20 or more modified internucleotidic linkages.

270. The composition of any one of the preceding embodiments, wherein each oligonucleotide of the first plurality comprises about 25 or more modified internucleotidic linkages.

271. The composition of any one of the preceding embodiments, wherein about 5% of the internucleotidic linkages in each oligonucleotide of the first plurality are modified internucleotidic linkages.

272. The composition of any one of the preceding embodiments, wherein about 10% of the internucleotidic linkages in each oligonucleotide of the first plurality are modified internucleotidic linkages.

273. The composition of any one of the preceding embodiments, wherein about 20% of the internucleotidic linkages in each oligonucleotide of the first plurality are modified internucleotidic linkages.

274. The composition of any one of the preceding embodiments, wherein about 30% of the internucleotidic linkages in each oligonucleotide of the first plurality are modified internucleotidic linkages.

275. The composition of any one of the preceding embodiments, wherein about 40% of the internucleotidic linkages in each oligonucleotide of the first plurality are modified internucleotidic linkages.

276. The composition of any one of the preceding embodiments, wherein about 50% of the internucleotidic linkages in each oligonucleotide of the first plurality are modified internucleotidic linkages.

277. The composition of any one of the preceding embodiments, wherein about 60% of the internucleotidic linkages in each oligonucleotide of the first plurality are modified internucleotidic linkages.

278. The composition of any one of the preceding embodiments, wherein about 70% of the internucleotidic linkages in each oligonucleotide of the first plurality are modified internucleotidic linkages.

279. The composition of any one of the preceding embodiments, wherein about 80% of the internucleotidic linkages in each oligonucleotide of the first plurality are modified internucleotidic linkages.

280. The composition of any one of the preceding embodiments, wherein about 85% of the internucleotidic linkages in each oligonucleotide of the first plurality are modified internucleotidic linkages.

281. The composition of any one of the preceding embodiments, wherein about 90% of the internucleotidic linkages in each oligonucleotide of the first plurality are modified internucleotidic linkages.

282. The composition of any one of the preceding embodiments, wherein about 95% of the internucleotidic linkages in each oligonucleotide of the first plurality are modified internucleotidic linkages.

283. The composition of any one of the preceding embodiments, wherein each oligonucleotide of the first plurality comprises no more than about 25 consecutive natural phosphate linkages.

284. The composition of any one of the preceding embodiments, wherein each oligonucleotide of the first plurality comprises no more than about 20 consecutive natural phosphate linkages.

285. The composition of any one of the preceding embodiments, wherein each oligonucleotide of the first plurality comprises no more than about 15 consecutive natural phosphate linkages.

286. The composition of any one of the preceding embodiments, wherein each oligonucleotide of the first plurality comprises no more than about 10 consecutive natural phosphate linkages.

287. The composition of any one of the preceding embodiments, wherein each oligonucleotide of the first plurality comprises no more than about 9 consecutive natural phosphate linkages.

288. The composition of any one of the preceding embodiments, wherein each oligonucleotide of the first plurality comprises no more than about 8 consecutive natural phosphate linkages.

289. The composition of any one of the preceding embodiments, wherein each oligonucleotide of the first plurality comprises no more than about 7 consecutive natural phosphate linkages.

290. The composition of any one of the preceding embodiments, wherein each oligonucleotide of the first plurality comprises no more than about 6 consecutive natural phosphate linkages.

291. The composition of any one of the preceding embodiments, wherein each oligonucleotide of the first plurality comprises no more than about 5 consecutive natural phosphate linkages.

292. The composition of any one of the preceding embodiments, wherein each oligonucleotide of the first plurality comprises no more than about 4 consecutive natural phosphate linkages.

293. The composition of any one of the preceding embodiments, wherein each oligonucleotide of the first plurality comprises no more than about 3 consecutive natural phosphate linkages.

294. The composition of any one of the preceding embodiments, wherein each oligonucleotide of the first plurality comprises no more than about 2 consecutive natural phosphate linkages.

295. The composition of any one of the preceding embodiments, wherein each oligonucleotide of the first plurality comprises no more than about 10 consecutive DNA nucleotides.

296. The composition of any one of the preceding embodiments, wherein each oligonucleotide of the first plurality comprises no more than about 9 consecutive DNA nucleotides.

297. The composition of any one of the preceding embodiments, wherein each oligonucleotide of the first plurality comprises no more than about 8 consecutive DNA nucleotides.

298. The composition of any one of the preceding embodiments, wherein each oligonucleotide of the first plurality comprises no more than about 7 consecutive DNA nucleotides.

299. The composition of any one of the preceding embodiments, wherein each oligonucleotide of the first plurality comprises no more than about 6 consecutive DNA nucleotides.

300. The composition of any one of the preceding embodiments, wherein each oligonucleotide of the first plurality comprises no more than about 5 consecutive DNA nucleotides.

301. The composition of any one of the preceding embodiments, wherein each oligonucleotide of the first plurality comprises no more than about 4 consecutive DNA nucleotides.

302. The composition of any one of the preceding embodiments, wherein each oligonucleotide of the first plurality comprises no more than about 3 consecutive DNA nucleotides.

303. The composition of any one of the preceding embodiments, wherein each oligonucleotide of the first plurality comprises no more than about 2 consecutive DNA nucleotides.

304. The composition of any one of the preceding embodiments, wherein each oligonucleotide of the first plurality comprises no more than about 25 natural phosphate linkages.

305. The composition of any one of the preceding embodiments, wherein each oligonucleotide of the first plurality comprises no more than about 20 natural phosphate linkages.

306. The composition of any one of the preceding embodiments, wherein each oligonucleotide of the first plurality comprises no more than about 15 natural phosphate linkages.

307. The composition of any one of the preceding embodiments, wherein each oligonucleotide of the first plurality comprises no more than about 10 natural phosphate linkages.

308. The composition of any one of the preceding embodiments, wherein each oligonucleotide of the first plurality comprises no more than about 5 natural phosphate linkages.

309. The composition of any one of the preceding embodiments, wherein each oligonucleotide of the first plurality comprises no more than about 25 DNA nucleotides.

310. The composition of any one of the preceding embodiments, wherein each oligonucleotide of the first plurality comprises no more than about 20 DNA nucleotides.

311. The composition of any one of the preceding embodiments, wherein each oligonucleotide of the first plurality comprises no more than about 15 DNA nucleotides.

312. The composition of any one of the preceding embodiments, wherein each oligonucleotide of the first plurality comprises no more than about 10 DNA nucleotides.

313. The composition of any one of the preceding embodiments, wherein each oligonucleotide of the first plurality comprises no more than about 5 DNA nucleotides.

314. The composition of any one of the preceding embodiments, wherein each oligonucleotide of the first plurality comprises no more than about 95% natural phosphate linkages.

315. The composition of any one of the preceding embodiments, wherein each oligonucleotide of the first plurality comprises no more than about 90% natural phosphate linkages.

316. The composition of any one of the preceding embodiments, wherein each oligonucleotide of the first plurality comprises no more than about 85% natural phosphate linkages.

317. The composition of any one of the preceding embodiments, wherein each oligonucleotide of the first plurality comprises no more than about 80% natural phosphate linkages.

318. The composition of any one of the preceding embodiments, wherein each oligonucleotide of the first plurality comprises no more than about 70% natural phosphate linkages.

319. The composition of any one of the preceding embodiments, wherein each oligonucleotide of the first plurality comprises no more than about 60% natural phosphate linkages.

320. The composition of any one of the preceding embodiments, wherein each oligonucleotide of the first plurality comprises no more than about 50% natural phosphate linkages.

321. The composition of any one of the preceding embodiments, wherein each oligonucleotide of the first plurality comprises no more than about 40% natural phosphate linkages.

322. The composition of any one of the preceding embodiments, wherein each oligonucleotide of the first plurality comprises no more than about 30% natural phosphate linkages.

323. The composition of any one of the preceding embodiments, wherein each oligonucleotide of the first plurality comprises no more than about 20% natural phosphate linkages.

324. The composition of any one of the preceding embodiments, wherein each oligonucleotide of the first plurality comprises no more than about 10% natural phosphate linkages.

325. The composition of any one of the preceding embodiments, wherein each oligonucleotide of the first plurality comprises no more than about 5% natural phosphate linkages.

326. An oligonucleotide composition comprising a first plurality of oligonucleotides comprising one or more wing regions and a core region, wherein:

- oligonucleotides of the first plurality have the same base sequence; and
- each wing region independently comprises one or more modified internucleotidic linkages and optionally one or more natural phosphate linkages, and the core region independently comprises one or more modified internucleotidic linkages; or
- each wing region independently comprises one or more modified sugar moieties, and the core region comprises one or more un-modified sugar moieties.

327. The composition of any one of the preceding embodiments, wherein the oligonucleotides comprise one or more wing regions and a core region, wherein:

- oligonucleotides of the first plurality have the same base sequence;
- each wing independently has a length of two or more bases, and independently comprises one or more modified internucleotidic linkages and optionally one or more natural phosphate linkages; and
- the core region independently has a length of two or more bases and independently comprises one or more modified internucleotidic linkages.

328. The composition of any one of the preceding embodiments, wherein a wing has the same or lower percentage of modified internucleotidic linkages than the core.

329. The composition of any one of the preceding embodiments, wherein each wing independently has the same or lower percentage of modified internucleotidic linkages than the core.

330. The composition of any one of the preceding embodiments, wherein a wing has a lower percentage of modified internucleotidic linkages that the core.

331. The composition of any one of the preceding embodiments, wherein a wing has one or more natural phosphate linkages.

332. The composition of any one of the preceding embodiments, wherein each wing independently has one or more natural phosphate linkages.

333. The composition of any one of the preceding embodiments, wherein has a wing to the 5' of the core has a modified internucleotidic linkage at its 5'-end.

334. The composition of any one of the preceding embodiments, wherein has a wing to the 3' of the core has a modified internucleotidic linkage at its 3'-end.

335. The composition of any one of the preceding embodiments, wherein a wing comprises a modified internucleotidic linkage followed by one or more natural phosphate linkages in the wing.

336. The composition of any one of the preceding embodiments, wherein a wing to the 5' of a core comprises a modified internucleotidic linkage followed by one or more natural phosphate linkages in the wing.

337. The composition of any one of the preceding embodiments, wherein a wing to the 5' of a core comprises a modified internucleotidic linkage followed by two or more consecutive natural phosphate linkages in the wing.

338. The composition of any one of the preceding embodiments, wherein a wing comprises a modified internucleotidic linkage preceded by one or more natural phosphate linkages in the wing.

339. The composition of any one of the preceding embodiments, wherein a wing to the 3' of a core comprises a modified internucleotidic linkage preceded by one or more natural phosphate linkages in the wing.

340. The composition of any one of the preceding embodiments, wherein a wing to the 3' of a core comprises a modified internucleotidic linkage preceded by two or more consecutive natural phosphate linkages in the wing.

341. The composition of any one of the preceding embodiments, wherein a wing is to the 5'-end of the core and comprises a natural phosphate linkage between the two nucleosides at its 3'-end.

342. The composition of any one of the preceding embodiments, wherein a wing is to the 3'-end of the core and comprises a natural phosphate linkage between the two nucleosides at its 5'-end;

343. The composition of any one of the preceding embodiments, wherein the first plurality comprises at least about 10% of the oligonucleotides in the composition.

344. The composition of any one of the preceding embodiments, wherein the first plurality comprises at least about 20% of the oligonucleotides in the composition.

345. The composition of any one of the preceding embodiments, wherein the first plurality comprises at least about 30% of the oligonucleotides in the composition.

346. The composition of any one of the preceding embodiments, wherein the first plurality comprises at least about 60% of the oligonucleotides in the composition.

347. The composition of any one of the preceding embodiments, wherein the first plurality comprises at least about 70% of the oligonucleotides in the composition.

348. The composition of any one of the preceding embodiments, wherein the first plurality comprises at least about 80% of the oligonucleotides in the composition.

349. The composition of any one of the preceding embodiments, wherein the first plurality comprises at least about 85% of the oligonucleotides in the composition.

350. The composition of any one of the preceding embodiments, wherein the first plurality comprises at least about 90% of the oligonucleotides in the composition.

351. The composition of any one of the preceding embodiments, wherein the first plurality comprises at least about 95% of the oligonucleotides in the composition.

352. The composition of any one of the preceding embodiments, comprising a first plurality of oligonucleotides of a particular oligonucleotide type defined by:

1) base sequence;

2) pattern of backbone linkages;

3) pattern of backbone chiral centers; and 4) pattern of backbone phosphorus modifications.

353. The composition of any one of the preceding embodiments, wherein the composition comprises a first plurality of oligonucleotides of a particular oligonucleotide type, wherein oligonucleotides of a particular oligonucleotide type have a common pattern of base modification and pattern of sugar modification.

354. The composition of any one of the preceding embodiments, wherein the composition comprises a first plurality of oligonucleotides of a particular oligonucleotide type, wherein oligonucleotides of a particular oligonucleotide type are structurally identical.

355. The composition of any one of the preceding embodiments, wherein a first plurality of oligonucleotides comprise two wing regions and a core region.

356. The composition of any one of the preceding embodiments, wherein a first plurality of oligonucleotides comprise no more than two wing regions and no more than one core region.

357. The composition of any one of the preceding embodiments, wherein a first plurality of oligonucleotides have a wing-core-wing structure.

358. The composition of any one of the preceding embodiments, wherein a first plurality of oligonucleotides are gapmers having a wing-core-wing structure.

359. The composition of any one of embodiments 1-282, wherein a first plurality of oligonucleotides comprise no more than one wing region and no more than one core region.

360. The composition of any one of embodiments 1-282, wherein a first plurality of oligonucleotides are hemimers having a wing-core structure.

361. The composition of any one of embodiments 1-282, wherein a first plurality of oligonucleotides are hemimers having a core-wing structure.

362. The composition of any one of the preceding embodiments, wherein a wing comprises a chiral internucleotidic linkage.

363. The composition of any one of the preceding embodiments, wherein a wing comprises no more than 20% chiral internucleotidic linkages.

364. The composition of any one of the preceding embodiments, wherein each wing independently comprises a chiral internucleotidic linkage.

365. The composition of any one of the preceding embodiments, wherein each wing independently comprises no more than 20% chiral internucleotidic linkages.

366. The composition of any one of embodiments 1-326 and 359-363, wherein a wing to the 5'-end of the core comprises a chiral internucleotidic linkage at the 5'-end of the wing.

367. The composition of any one of embodiments 1-326 and 359-363, wherein a wing to the 3'-end of the core comprises a chiral internucleotidic linkage at the 3'-end of the wing.

368. The composition of any one of the preceding embodiments, wherein a wing has only one chiral internucleotidic linkage, and each of the other internucleotidic linkages of the wing is a natural phosphate linkage (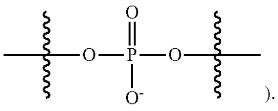).

369. The composition of any one of the preceding embodiments, wherein the chiral internucleotidic linkage has the structure of formula I.

370. The composition of any one of the preceding embodiments, wherein a chiral internucleotidic linkage has the structure of formula I, and wherein X is S, and Y and Z are O.

371. The composition of any one of the preceding embodiments, wherein a chiral internucleotidic linkage is a phosphorothioate linkage.

372. The composition of any one of the preceding embodiments, wherein a chiral internucleotidic linkage is Sp.

373. The composition of any one of the preceding embodiments, wherein each chiral internucleotidic linkage is Sp.

374. The composition of any one of embodiments 1-372, wherein a chiral internucleotidic linkage is Rp.

375. The composition of any one of embodiments 1-371, wherein each chiral internucleotidic linkage is Rp.

376. The composition of any one of embodiments 1-374, wherein a wing comprises an Sp phosphorothioate linkage.

377. The composition of any one of embodiments 1-374, wherein each wing independently comprises an Sp phosphorothioate linkage.

378. The composition of any one of embodiments 1-360, 362-374, and 376-377, wherein a wing is to the 5'-end of the core, and the wing has an Sp phosphorothioate linkage.

379. The composition of any one of embodiments 1-360, 362-374, and 376-378, wherein a wing is to the 5'-end of the core, and the wing has an Sp phosphorothioate linkage at the 5'-end of the wing.

380. The composition of any one of embodiments 1-360, 362-374, and 376-379, wherein a wing is to the 5'-end of the core, the wing has an Sp phosphorothioate linkage at the 5'-end of the wing, and each of the other internucleotidic linkages of the wing is a natural phosphate linkage (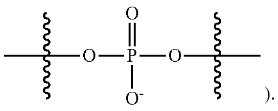).

381. The composition of any one of embodiments 1-359, 361-374 and 376-377, wherein a wing is to the 3'-end of the core, and the wing has an Sp phosphorothioate linkage at the 3'-end of the wing.

382. The composition of any one of embodiments 1-359, 361-374, 376-377 and 381, wherein a wing is to the 3'-end of the core, and the wing has an Sp phosphorothioate linkage at the 3'-end of the wing.

383. The composition of any one of embodiments 1-359, 361-374, 376-377 and 381-382, wherein one wing is to the 3'-end of the common core, the wing has an Sp phosphorothioate linkage at the 3'-end of the wing, and each of the other internucleotidic linkages of the wing is a natural phosphate linkage (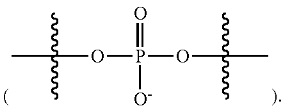).

384. The composition of any one of embodiments 1-372 and 374-383, wherein a wing comprises an Rp phosphorothioate linkage.

385. The composition of any one of embodiments 1-372 and 374-383, wherein each wing independently comprises an Rp phosphorothioate linkage.

386. The composition of any one of embodiments 1-360, 362-372 and 374-385, wherein a wing is to the 5'-end of the core, and the wing has an Rp phosphorothioate linkage.

387. The composition of any one of embodiments 1-360, 362-372 and 374-386, wherein a wing is to the 5'-end of the core, and the wing has an Rp phosphorothioate linkage at the 5'-end of the wing.

388. The composition of any one of embodiments 1-360, 362-372 and 374-387, wherein a wing is to the 5'-end of the core, the wing has an Rp phosphorothioate linkage at the 5'-end of the wing, and each of the other internucleotidic linkages of the wing is a natural phosphate linkage (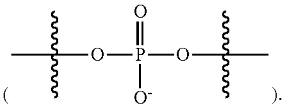).

389. The composition of any one of embodiments 1-359, 361-372 and 374-385, wherein a wing is to the 3'-end of the core, and the wing has an Rp phosphorothioate.

390. The composition of any one of embodiments 1-359, 361-372 and 374-385, wherein a wing is to the 3'-end of the core, and the wing has an Rp phosphorothioate linkage at the 3'-end of the wing.

391. The composition of any one of embodiments 1-359, 361-372 and 374-385, wherein one wing is to the 3'-end of the common core, the wing has an Rp phosphorothioate linkage at the 3'-end of the wing, and each of the other internucleotidic linkages of the wing is a natural phosphate linkage (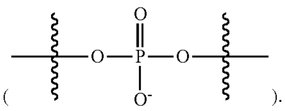).

392. The composition of any one of embodiments 1-371, wherein a wing is to the 5'-end of a core, and its 5'-end internucleotidic linkage is a chiral internucleotidic linkage.

393. The composition of any one of embodiments 1-371, wherein a wing is to the 5'-end of a core, and its 5'-end internucleotidic linkage is an Sp chiral internucleotidic linkage.

394. The composition of any one of embodiments 1-371, wherein a wing is to the 5'-end of a core, and its 5'-end internucleotidic linkage is an Rp chiral internucleotidic linkage.

395. The composition of any one of embodiments 1-371 and 392-394, wherein a wing is to the 3'-end of a core, and its 3'-end internucleotidic linkage is a chiral internucleotidic linkage.

396. The composition of any one of embodiments 1-371 and 392-394, wherein a wing is to the 3'-end of a core, and its 3'-end internucleotidic linkage is an Sp chiral internucleotidic linkage.

397. The composition of any one of embodiments 1-371 and 392-394, wherein a wing is to the 3'-end of a core, and its 3'-end internucleotidic linkage is an Rp chiral internucleotidic linkage.

398. The composition of any one of the preceding embodiments, wherein a wing independently comprises a natural phosphate linkage ( 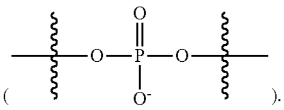 ).

399. The composition of any one of the preceding embodiments, wherein a wing independently comprises two or more natural phosphate linkages ( 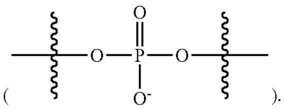 ).

400. The composition of any one of the preceding embodiments, wherein a wing independently comprises two or more natural phosphate linkages, and all natural phosphate linkages within a wing are consecutive.

401. The composition of any one of the preceding embodiments, wherein each wing independently comprises a natural phosphate linkage ( 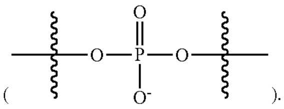 ).

402. The composition of any one of the preceding embodiments, wherein each wing independently comprises two or more natural phosphate linkages.

403. The composition of any one of the preceding embodiments, wherein each wing independently comprises three or more natural phosphate linkages.

404. The composition of any one of the preceding embodiments, wherein each wing independently comprises four or more natural phosphate linkages.

405. The composition of any one of the preceding embodiments, wherein each wing independently comprises five or more natural phosphate linkages.

406. The composition of any one of the preceding embodiments, wherein each wing independently comprises two or more natural phosphate linkages, and all natural phosphate linkages within a wing are consecutive.

407. The composition of any one of the preceding embodiments, wherein each wing independently comprises three or more natural phosphate linkages, and all natural phosphate linkages within a wing are consecutive.

408. The composition of any one of the preceding embodiments, wherein each wing independently comprises four or more natural phosphate linkages, and all natural phosphate linkages within a wing are consecutive.

409. The composition of any one of the preceding embodiments, wherein each wing independently comprises five or more natural phosphate linkages, and all natural phosphate linkages within a wing are consecutive.

410. The composition of any one of the preceding embodiments, wherein at least 5% of the internucleotidic linkages in a wing are natural phosphate linkages.

411. The composition of any one of the preceding embodiments, wherein at least 10% of the internucleotidic linkages in a wing are natural phosphate linkages.

412. The composition of any one of the preceding embodiments, wherein at least 20% of the internucleotidic linkages in a wing are natural phosphate linkages.

413. The composition of any one of the preceding embodiments, wherein at least 30% of the internucleotidic linkages in a wing are natural phosphate linkages.

414. The composition of any one of the preceding embodiments, wherein at least 40% of the internucleotidic linkages in a wing are natural phosphate linkages.

415. The composition of any one of the preceding embodiments, wherein at least 50% of the internucleotidic linkages in a wing are natural phosphate linkages.

416. The composition of any one of the preceding embodiments, wherein at least 60% of the internucleotidic linkages in a wing are natural phosphate linkages.

417. The composition of any one of the preceding embodiments, wherein at least 70% of the internucleotidic linkages in a wing are natural phosphate linkages.

418. The composition of any one of the preceding embodiments, wherein at least 80% of the internucleotidic linkages in a wing are natural phosphate linkages.

419. The composition of any one of the preceding embodiments, wherein at least 90% of the internucleotidic linkages in a wing are natural phosphate linkages.

420. The composition of any one of the preceding embodiments, wherein at least 95% of the internucleotidic linkages in a wing are natural phosphate linkages.

421. The composition of any one of the preceding embodiments, wherein at least 5% of the internucleotidic linkages in each wing are independently natural phosphate linkages.

422. The composition of any one of the preceding embodiments, wherein at least 10% of the internucleotidic linkages in each wing are independently natural phosphate linkages.

423. The composition of any one of the preceding embodiments, wherein at least 20% of the internucleotidic linkages in each wing are independently natural phosphate linkages.

424. The composition of any one of the preceding embodiments, wherein at least 30% of the internucleotidic linkages in each wing are independently natural phosphate linkages.

425. The composition of any one of the preceding embodiments, wherein at least 40% of the internucleotidic linkages in each wing are independently natural phosphate linkages.

426. The composition of any one of the preceding embodiments, wherein at least 50% of the internucleotidic linkages in each wing are independently natural phosphate linkages.

427. The composition of any one of the preceding embodiments, wherein at least 60% of the internucleotidic linkages in each wing are independently natural phosphate linkages.

428. The composition of any one of the preceding embodiments, wherein at least 70% of the internucleotidic linkages in each wing are independently natural phosphate linkages.

429. The composition of any one of the preceding embodiments, wherein at least 80% of the internucleotidic linkages in each wing are independently natural phosphate linkages.

430. The composition of any one of the preceding embodiments, wherein at least 90% of the internucleotidic linkages in each wing are independently natural phosphate linkages.

431. The composition of any one of the preceding embodiments, wherein at least 95% of the internucleotidic linkages in each wing are independently natural phosphate linkages.

432. The composition of any one of the preceding embodiments, wherein a wing comprises no more than 15 modified phosphate linkages.

433. The composition of any one of the preceding embodiments, wherein a wing comprises no more than 10 modified phosphate linkages.

434. The composition of any one of the preceding embodiments, wherein a wing comprises no more than 9 modified phosphate linkages.

435. The composition of any one of the preceding embodiments, wherein a wing comprises no more than 8 modified phosphate linkages.

436. The composition of any one of the preceding embodiments, wherein a wing comprises no more than 7 modified phosphate linkages.

437. The composition of any one of the preceding embodiments, wherein a wing comprises no more than 6 modified phosphate linkages.

438. The composition of any one of the preceding embodiments, wherein a wing comprises no more than 5 modified phosphate linkages.

439. The composition of any one of the preceding embodiments, wherein a wing comprises no more than 4 modified phosphate linkages.

440. The composition of any one of the preceding embodiments, wherein a wing comprises no more than 3 modified phosphate linkages.

441. The composition of any one of the preceding embodiments, wherein a wing comprises no more than 2 modified phosphate linkages.

442. The composition of any one of the preceding embodiments, wherein a wing comprises no more than 1 modified phosphate linkage.

443. The composition of any one of the preceding embodiments, wherein each wing independently comprises no more than 15 modified phosphate linkages.

444. The composition of any one of the preceding embodiments, wherein each wing independently comprises no more than 10 modified phosphate linkages.

445. The composition of any one of the preceding embodiments, wherein each wing independently comprises no more than 9 modified phosphate linkages.

446. The composition of any one of the preceding embodiments, wherein each wing independently comprises no more than 8 modified phosphate linkages.

447. The composition of any one of the preceding embodiments, wherein each wing independently comprises no more than 7 modified phosphate linkages.

448. The composition of any one of the preceding embodiments, wherein each wing independently comprises no more than 6 modified phosphate linkages.

449. The composition of any one of the preceding embodiments, wherein each wing independently comprises no more than 5 modified phosphate linkages.

450. The composition of any one of the preceding embodiments, wherein each wing independently comprises no more than 4 modified phosphate linkages.

451. The composition of any one of the preceding embodiments, wherein each wing independently comprises no more than 3 modified phosphate linkages.

452. The composition of any one of the preceding embodiments, wherein each wing independently comprises no more than 2 modified phosphate linkages.

453. The composition of any one of the preceding embodiments, wherein each wing independently comprises no more than 1 modified phosphate linkage.

454. The composition of any one of the preceding embodiments, wherein a wing comprises less than 100% modified phosphate linkages.

455. The composition of any one of the preceding embodiments, wherein a wing comprises no more than 95% modified phosphate linkages.

456. The composition of any one of the preceding embodiments, wherein a wing comprises no more than 90% modified phosphate linkages.

457. The composition of any one of the preceding embodiments, wherein a wing comprises no more than 80% modified phosphate linkages.

458. The composition of any one of the preceding embodiments, wherein a wing comprises no more than 70% modified phosphate linkages.

459. The composition of any one of the preceding embodiments, wherein a wing comprises no more than 60% modified phosphate linkages.

460. The composition of any one of the preceding embodiments, wherein a wing comprises no more than 50% modified phosphate linkages.

461. The composition of any one of the preceding embodiments, wherein a wing comprises no more than 40% modified phosphate linkages.

462. The composition of any one of the preceding embodiments, wherein a wing comprises no more than 30% modified phosphate linkages.

463. The composition of any one of the preceding embodiments, wherein a wing comprises no more than 20% modified phosphate linkages.

464. The composition of any one of the preceding embodiments, wherein a wing comprises no more than 10% modified phosphate linkage.

465. The composition of any one of the preceding embodiments, wherein each wing independently comprises less than 100% modified phosphate linkages.

466. The composition of any one of the preceding embodiments, wherein each wing independently comprises no more than 95% modified phosphate linkages.

467. The composition of any one of the preceding embodiments, wherein each wing independently comprises no more than 90% modified phosphate linkages.

468. The composition of any one of the preceding embodiments, wherein each wing independently comprises no more than 80% modified phosphate linkages.

469. The composition of any one of the preceding embodiments, wherein each wing independently comprises no more than 70% modified phosphate linkages.

470. The composition of any one of the preceding embodiments, wherein each wing independently comprises no more than 60% modified phosphate linkages.

471. The composition of any one of the preceding embodiments, wherein each wing independently comprises no more than 50% modified phosphate linkages.

472. The composition of any one of the preceding embodiments, wherein each wing independently comprises no more than 40% modified phosphate linkages.

473. The composition of any one of the preceding embodiments, wherein each wing independently comprises no more than 30% modified phosphate linkages.

474. The composition of any one of the preceding embodiments, wherein each wing independently comprises no more than 20% modified phosphate linkages.

475. The composition of any one of the preceding embodiments, wherein each wing independently comprises no more than 10% modified phosphate linkage.

476. The composition of any one of the preceding embodiments, wherein an internucleotidic linkage of a wing region is independently selected from a natural phosphate linkage and a modified phosphate linkage having the structure of formula I.

477. The composition of any one of the preceding embodiments, wherein an internucleotidic linkage of a wing region is independently selected from a natural phosphate linkage and a phosphorothioate linkage.

478. The composition of any one of embodiments 1-361, wherein each internucleotidic linkage within a wing is a natural phosphate linkage.

479. The composition of any one of embodiments 1-361, wherein each internucleotidic linkage within each wing is a natural phosphate linkage.

480. The composition of any one of embodiments 1-361, wherein each internucleotidic linkage within a wing is a chiral internucleotidic linkage.

481. The composition of any one of embodiments 1-361, wherein each internucleotidic linkage within each wing is a chiral internucleotidic linkage.

482. The composition of any one of the preceding embodiments, wherein a wing has a length of three or more bases.

483. The composition of any one of the preceding embodiments, wherein one wing has a length of four or more bases.

484. The composition of any one of the preceding embodiments, wherein one wing has a length of five or more bases.

485. The composition of any one of the preceding embodiments, wherein one wing has a length of six or more bases.

486. The composition of any one of the preceding embodiments, wherein one wing has a length of seven or more bases.

487. The composition of any one of the preceding embodiments, wherein one wing has a length of eight or more bases.

488. The composition of any one of the preceding embodiments, wherein one wing has a length of nine or more bases.

489. The composition of any one of the preceding embodiments, wherein one wing has a length of ten or more bases.

490. The composition of any one of the preceding embodiments, wherein each wing independently has a length of three or more bases.

491. The composition of any one of the preceding embodiments, wherein each wing independently has a length of four or more bases.

492. The composition of any one of the preceding embodiments, wherein each wing independently has a length of five or more bases.

493. The composition of any one of the preceding embodiments, wherein each wing independently has a length of six or more bases.

494. The composition of any one of the preceding embodiments, wherein each wing independently has a length of seven or more bases.

495. The composition of any one of the preceding embodiments, wherein each wing independently has a length of eight or more bases.

496. The composition of any one of the preceding embodiments, wherein each wing independently has a length of nine or more bases.

497. The composition of any one of the preceding embodiments, wherein each wing independently has a length of ten or more bases.

498. The composition of any one of embodiments 1-482, wherein a wing has a length of three bases.

499. The composition of any one of embodiments 1-482, wherein a wing has a length of four bases.

500. The composition of any one of embodiments 1-482, wherein a wing has a length of five bases.

501. The composition of any one of embodiments 1-482, wherein a wing has a length of six bases.

502. The composition of any one of embodiments 1-482, wherein a wing has a length of seven bases.

503. The composition of any one of embodiments 1-482, wherein a wing has a length of eight bases.

504. The composition of any one of embodiments 1-482, wherein a wing has a length of nine bases.

505. The composition of any one of embodiments 1-482, wherein a wing has a length of ten bases.

506. The composition of any one of embodiments 1-482, wherein a wing has a length of 11 bases.

507. The composition of any one of embodiments 1-482, wherein a wing has a length of 12 bases.

508. The composition of any one of embodiments 1-482, wherein a wing has a length of 13 bases.

509. The composition of any one of embodiments 1-482, wherein a wing has a length of 14 bases.

510. The composition of any one of embodiments 1-482, wherein a wing has a length of 15 bases.

511. The composition of any one of embodiments 1-482, wherein each wing has the same length.

512. The composition of any one of the preceding embodiments, wherein a wing is defined by sugar modifications relative to a core.

513. The composition of any one of the preceding embodiments, wherein each wing independently comprises a modified sugar moiety.

514. The composition of any one of the preceding embodiments, wherein each wing sugar moiety is independently a modified sugar moiety.

515. The composition of any one of the preceding embodiments, wherein a modified sugar moiety comprises a high-affinity sugar modification.

516. The composition of any one of the preceding embodiments, wherein a modified sugar moiety has a 2'-modification.

517. The composition of any one of the preceding embodiments, wherein a modified sugar moiety comprises a bicyclic sugar modification.

518. The composition of any one of the preceding embodiments, wherein a modified sugar moiety comprises a bicyclic sugar modification having a -L- or —O-L- bridge connecting two ring carbon atoms.

519. The composition of any one of the preceding embodiments, wherein a modified sugar moiety comprises a bicyclic sugar modification having a 4'-$CH(CH_3)$—O-2' bridge.

520. The composition of any one of embodiments 1-516, wherein a modified sugar moiety comprises a 2'-modification, wherein a 2'-modification is 2'-$OR^1$.

521. The composition of any one of embodiments 1-516, wherein a modified sugar moiety comprises a 2'-modification, wherein a 2'-modification is 2'-$OR^1$, wherein $R^1$ is optionally substituted $C_{1-6}$ alkyl.

522. The composition of any one of embodiments 1-516, wherein a modified sugar moiety comprises a 2'-modification, wherein a 2'-modification is 2'-MOE.

523. The composition of any one of embodiments 1-516, wherein a modified sugar moiety comprises a 2'-modification, wherein a 2'-modification is 2'-OMe.

524. The composition of any one of embodiments 1-519, wherein a modified sugar moiety comprises a 2'-modification, wherein the 2'-modification is S-cEt.

525. The composition of any one of embodiments 1-516, wherein a modified sugar moiety comprises a 2'-modification, wherein the 2'-modification is FANA.

526. The composition of any one of embodiments 1-516, wherein a modified sugar moiety comprises a 2'-modification, wherein the 2'-modification is FRNA.

527. The composition of any one of embodiments 1-515, wherein a modified sugar moiety has a 5'-modification.

528. The composition of any one of embodiments 1-515, wherein a modified sugar moiety is R-5'-Me-DNA.

529. The composition of any one of embodiments 1-515, wherein a modified sugar moiety is S-5'-Me-DNA.

530. The composition of any one of embodiments 1-515, wherein a modified sugar moiety is FHNA.

531. The composition of any one of the preceding embodiments, wherein each wing sugar moiety is modified.

532. The composition of any one of the preceding embodiments, wherein all modified wing sugar moieties within a wing have the same modification.

533. The composition of any one of the preceding embodiments, wherein all modified wing sugar moieties have the same modification.

534. The composition of any one of embodiments 1-531, wherein at least one modified wing sugar moiety is different than another modified wing sugar moiety.

535. The composition of any one of the preceding embodiments, wherein a wing comprises a modified base.

536. The composition of any one of the preceding embodiments, wherein a wing comprises a 2S-dT.

537. The composition of any one of the preceding embodiments, wherein the core region has a length of five or more bases.

538. The composition of any one of the preceding embodiments, wherein the core region has a length of six or more bases.

539. The composition of any one of the preceding embodiments, wherein the core region has a length of seven or more bases.

540. The composition of any one of the preceding embodiments, wherein the core region has a length of eight or more bases.

541. The composition of any one of the preceding embodiments, wherein the core region has a length of nine or more bases.

542. The composition of any one of the preceding embodiments, wherein the core region has a length of ten or more bases.

543. The composition of any one of the preceding embodiments, wherein the core region has a length of 11 or more bases.

544. The composition of any one of the preceding embodiments, wherein the core region has a length of 12 or more bases.

545. The composition of any one of the preceding embodiments, wherein the core region has a length of 13 or more bases.

546. The composition of any one of the preceding embodiments, wherein the core region has a length of 14 or more bases.

547. The composition of any one of the preceding embodiments, wherein the core region has a length of 15 or more bases.

548. The composition of any one of 1-536, wherein the core region has a length of five bases.

549. The composition of any one of 1-536, wherein the core region has a length of six bases.

550. The composition of any one of 1-536, wherein the core region has a length of seven bases.

551. The composition of any one of 1-536, wherein the core region has a length of eight bases.

552. The composition of any one of 1-536, wherein the core region has a length of nine bases.

553. The composition of any one of 1-536, wherein the core region has a length of ten bases.

554. The composition of any one of 1-536, wherein the core region has a length of 11 bases.

555. The composition of any one of 1-536, wherein the core region has a length of 12 bases.

556. The composition of any one of 1-536, wherein the core region has a length of 13 bases.

557. The composition of any one of 1-536, wherein the core region has a length of 14 bases.

558. The composition of any one of 1-536, wherein the core region has a length of 15 bases.

559. The composition of any one of the preceding embodiments, wherein the core region does not have any 2'-modification.

560. The composition of any one of the preceding embodiments, wherein each core sugar moiety is not modified.

561. The composition of any one of the preceding embodiments, wherein each sugar moiety of the core region is the natural DNA sugar moiety.

562. The composition of any one of the preceding embodiments, wherein the core region comprises a chiral internucleotidic linkage.

563. The composition of any one of the preceding embodiments, wherein each internucleotidic linkage of the core region is a chiral internucleotidic linkage.

564. The composition of any one of the preceding embodiments, wherein each internucleotidic linkage of the core region is a chiral internucleotidic linkage having the structure of formula I.

565. The composition of any one of the preceding embodiments, wherein each internucleotidic linkage of the core region is a chiral internucleotidic linkage having the structure of formula I, and wherein X is S, and Y and Z are O.

566. The composition of any one of the preceding embodiments, wherein each internucleotidic linkage of the core region is a chiral internucleotidic linkage having the structure of formula I, and wherein one -L-$R^1$ is not —H.

567. The composition of any one of embodiments 1-565, wherein each internucleotidic linkage of the core region is a phosphorothioate linkage.

568. The composition of any one of the preceding embodiments, wherein the core region has a pattern of backbone chiral center comprises (Sp)m(Rp)n, wherein m is 1-50, and n is 1-10.

569. The composition of any one of the preceding embodiments, wherein the core region has a pattern of backbone chiral center comprises (Sp)m(Rp)n, wherein m is 1-50, n is 1-10, and m>n.

570. The composition of any one of the preceding embodiments, wherein the core region has a pattern of backbone chiral center comprises (Sp)m(Rp)n, wherein m is 2, 3, 4, 5, 6, 7 or 8, and n is 1.

571. The composition of any one of embodiments 1-567, wherein the core region has a pattern of backbone chiral centers comprising (Rp)n(Sp)m, wherein m is 1-50 and n is 1-10.

572. The composition of any one of embodiments 1-567 and 571, wherein the core region has a pattern of backbone chiral centers comprising Rp(Sp)m, wherein m is 2, 3, 4, 5, 6, 7 or 8.

573. The composition of any one of embodiments 1-567 and 571-572, wherein the core region has a pattern of backbone chiral centers comprising $Rp(Sp)_2$.

574. The composition of any one of embodiments 1-567, wherein the core region has a pattern of backbone chiral centers comprising (Np)t(Rp)n(Sp)m, wherein t is 1-10, n is 1-10, m is 1-50, and each Np is independent Rp or Sp.

575. The composition of any one of embodiments 1-567 and 574, wherein the core region has a pattern of backbone chiral centers comprising (Sp)t(Rp)n(Sp)m, wherein t is 1-10, n is 1-10, m is 1-50.

576. The composition of any one of embodiments 1-567 and 574-575, wherein n is 1.

577. The composition of any one of embodiments 1-567 and 574-576, wherein t is 2, 3, 4, 5, 6, 7 or 8.

578. The composition of any one of embodiments 1-567 and 574-577, wherein m is 2, 3, 4, 5, 6, 7 or 8.

579. The composition of any one of embodiments 1-567 and 574-578, wherein at least one of t and m is greater than 5.

580. The composition of any one of the preceding embodiments, wherein the core region has a pattern of backbone chiral centers comprising SpSpRpSpSp.

581. The composition of any one of the preceding embodiments, wherein 50% or more of the chiral internucleotidic linkages in the core region have Sp configuration.

582. The composition of any one of the preceding embodiments, wherein 60% or more of the chiral internucleotidic linkages in the core region have Sp configuration.

583. The composition of any one of the preceding embodiments, wherein 70% or more of the chiral internucleotidic linkages in the core region have Sp configuration.

584. The composition of any one of the preceding embodiments, wherein 80% or more of the chiral internucleotidic linkages in the core region have Sp configuration.

585. The composition of any one of the preceding embodiments, wherein 90% or more of the chiral internucleotidic linkages in the core region have Sp configuration.

586. The composition of any one of the preceding embodiments, wherein each internucleotidic linkage in the core region is chiral, the core region has only one Rp, and each of the other internucleotidic linkages in the core region is Sp.

587. The composition of any one of the preceding embodiments, wherein each base moiety in the core is not modified.

588. The composition of any one of embodiments 1-586, wherein the core region comprises a modified base.

589. The composition of any one of embodiments 1-586, wherein the core region comprises a modified base, wherein a modified base is substituted A, T, C or G.

590. The composition of any one of embodiments 1-587, wherein each base moiety in the core region is independently selected from A, T, C and G.

591. The composition of any one of embodiments 1-586, wherein the core region is a DNA sequence whose phosphate linkages are independently replaced with phosphorothioate linkages.

592. The composition of any one of embodiments 326-591, wherein a 5'-wing region is a 5'-end region of any one of embodiments 1-325.

593. The composition of any one of embodiments 326-592, wherein a 3'-wing region is a 3'-end region of any one of embodiments 1-325.

594. The composition of any one of embodiments 326-593, wherein a core region is a middle region of any one of embodiments 1-325.

595. The composition of any one of embodiments 1-325, wherein a 5'-end region is a 5'-wing region of any one of embodiments 326-591.

596. The composition of any one of embodiments 1-325 and 595, wherein a 3'-end region is a 3'-wing region of any one of embodiments 326-591.

597. The composition of any one of embodiments 1-325 and 595-596, wherein a middle region is a core region of any one of embodiments 326-591.

598. The composition of any one of the preceding embodiments, wherein the oligonucleotides are single stranded.

599. The composition of any one of the preceding embodiments, wherein the oligonucleotides are antisense oligonucleotide, antagomir, microRNA, pre-microRNs, antimir, supermir, ribozyme, UI adaptor, RNA activator, RNAi agent, decoy oligonucleotide, triplex forming oligonucleotide, aptamer or adjuvant.

600. The composition of any one of the preceding embodiments, wherein the oligonucleotides are antisense oligonucleotides.

601. The composition of any one of the preceding embodiments, wherein the oligonucleotides have a length of greater than 10 bases.

602. The composition of any one of the preceding embodiments, wherein the oligonucleotides have a length of greater than 11 bases.

603. The composition of any one of the preceding embodiments, wherein the oligonucleotides have a length of greater than 12 bases.

604. The composition of any one of the preceding embodiments, wherein the oligonucleotides have a length of greater than 13 bases.

605. The composition of any one of the preceding embodiments, wherein the oligonucleotides have a length of greater than 14 bases.

606. The composition of any one of the preceding embodiments, wherein the oligonucleotides have a length of greater than 15 bases.

607. The composition of any one of the preceding embodiments, wherein the oligonucleotides have a length of greater than 16 bases.

608. The composition of any one of the preceding embodiments, wherein the oligonucleotides have a length of greater than 17 bases.

609. The composition of any one of the preceding embodiments, wherein the oligonucleotides have a length of greater than 18 bases.

610. The composition of any one of the preceding embodiments, wherein the oligonucleotides have a length of greater than 19 bases.

611. The composition of any one of the preceding embodiments, wherein the oligonucleotides have a length of greater than 20 bases.

612. The composition of any one of the preceding embodiments, wherein the oligonucleotides have a length of greater than 21 bases.

613. The composition of any one of the preceding embodiments, wherein the oligonucleotides have a length of greater than 22 bases.

614. The composition of any one of the preceding embodiments, wherein the oligonucleotides have a length of greater than 23 bases.

615. The composition of any one of the preceding embodiments, wherein the oligonucleotides have a length of greater than 24 bases.

616. The composition of any one of the preceding embodiments, wherein the oligonucleotides have a length of greater than 25 bases.

617. The composition of any one of the preceding embodiments, wherein the oligonucleotides have a length of less than about 200 bases.

618. The composition of any one of the preceding embodiments, wherein the oligonucleotides have a length of less than about 150 bases.

619. The composition of any one of the preceding embodiments, wherein the oligonucleotides have a length of less than about 100 bases.

620. The composition of any one of the preceding embodiments, wherein the oligonucleotides have a length of less than about 50 bases.

621. The composition of any one of the preceding embodiments, wherein the oligonucleotides have a length of less than about 40 bases.

622. The composition of any one of the preceding embodiments, wherein the oligonucleotides have a length of less than about 30 bases.

623. The composition of any one of the preceding embodiments, wherein the oligonucleotides have a length of 10 bases.

624. The composition of any one of the preceding embodiments, wherein the oligonucleotides have a length of 11 bases.

625. The composition of any one of the preceding embodiments, wherein the oligonucleotides have a length of 12 bases.

626. The composition of any one of the preceding embodiments, wherein the oligonucleotides have a length of 13 bases.

627. The composition of any one of the preceding embodiments, wherein the oligonucleotides have a length of 14 bases.

628. The composition of any one of the preceding embodiments, wherein the oligonucleotides have a length of 15 bases.

629. The composition of any one of the preceding embodiments, wherein the oligonucleotides have a length of 16 bases.

630. The composition of any one of the preceding embodiments, wherein the oligonucleotides have a length of 17 bases.

631. The composition of any one of the preceding embodiments, wherein the oligonucleotides have a length of 18 bases.

632. The composition of any one of the preceding embodiments, wherein the oligonucleotides have a length of 19 bases.

633. The composition of any one of the preceding embodiments, wherein the oligonucleotides have a length of 20 bases.

634. The composition of any one of the preceding embodiments, wherein the oligonucleotides have a length of 21 bases.

635. The composition of any one of the preceding embodiments, wherein the oligonucleotides have a length of 22 bases.

636. The composition of any one of the preceding embodiments, wherein the oligonucleotides have a length of 23 bases.

637. The composition of any one of the preceding embodiments, wherein the oligonucleotides have a length of 24 bases.

638. The composition of any one of the preceding embodiments, wherein the oligonucleotides have a length of 25 bases.

639. The composition of any one of the preceding embodiments, wherein oligonucleotides of a first plurality have a pattern of backbone chiral center comprising (Sp)m, wherein m is 1-50.

640. The composition of any one of the preceding embodiments, wherein oligonucleotides of a first plurality have a pattern of backbone chiral center comprising one or more (Rp)p(Sp)x(Rp)q(Sp)y, wherein each of p, x, q, y is independently 0-50, p+q>0, and x+y>0.

641. The composition of any one of the preceding embodiments, wherein oligonucleotides of a first plurality have a pattern of backbone chiral center comprising (Sp)m (Rp)n, wherein m is 1-50, and n is 1-10.

642. The composition of any one of the preceding embodiments, wherein oligonucleotides of a first plurality have a pattern of backbone chiral center comprising one or more (Sp)m(Rp)n, wherein m is 1-50, n is 1-10, and m>n.

643. The composition of any one of the preceding embodiments, wherein oligonucleotides of a first plurality have a pattern of backbone chiral center comprising one or more (Sp)m(Rp)n, wherein m is 2, 3, 4, 5, 6, 7 or 8, and n is 1.

644. The composition of any one of the preceding embodiments, wherein oligonucleotides of a first plurality have a pattern of backbone chiral center comprising one or more (Sp)m(Rp)n, wherein m is 2 and n is 1.

645. The composition of any one of embodiments 1-640, wherein oligonucleotides of a first plurality have a pattern of backbone chiral centers comprising one or more (Rp)n(Sp)m, wherein m is 1-50 and n is 1-10.

646. The composition of any one of embodiments 1-640 and 645, wherein oligonucleotides of a first plurality have a pattern of backbone chiral centers comprising Rp(Sp)m, wherein m is 2, 3, 4, 5, 6, 7 or 8.

647. The composition of any one of embodiments 1-640 and 645-646, wherein oligonucleotides of a first plurality have a pattern of backbone chiral centers comprising $Rp(Sp)_2$.

648. The composition of any one of embodiments 1-640, wherein oligonucleotides of a first plurality have a pattern of backbone chiral centers comprising (Np)t(Rp)n(Sp)m, wherein t is 1-10, n is 1-10, m is 1-50, and each Np is independent Rp or Sp.

649. The composition of any one of embodiments 1-640 and 648, wherein oligonucleotides of a first plurality have a pattern of backbone chiral centers comprising (Sp)t(Rp)n(Sp)m, wherein t is 1-10, n is 1-10, m is 1-50.

650. The composition of any one of embodiments 1-649, wherein n is 1.

651. The composition of any one of embodiments 1-640 and 648-649, wherein t is 2, 3, 4, 5, 6, 7 or 8.

652. The composition of any one of embodiments 1-650, wherein m is 2, 3, 4, 5, 6, 7 or 8.

653. The composition of any one of embodiments 1-640 and 649-651, wherein at least one of t and m is greater than 5.

654. The composition of any one of the preceding embodiments, wherein m is greater than 3.

655. The composition of any one of the preceding embodiments, wherein m is greater than 4.

656. The composition of any one of the preceding embodiments, wherein m is greater than 5.

657. The composition of any one of the preceding embodiments, wherein m is greater than 6.

658. The composition of any one of the preceding embodiments, wherein m is greater than 7.

659. The composition of any one of the preceding embodiments, wherein m is greater than 8.

660. The composition of any one of the preceding embodiments, wherein m is greater than 9.

661. The composition of any one of the preceding embodiments, wherein m is greater than 10.

662. The composition of any one of the preceding embodiments, wherein the core region has a pattern of backbone chiral centers comprising SpSpRpSpSp.

663. The composition of any one of the preceding embodiments, comprising one or more (Sp)m(Rp)n.

664. The composition of any one of the preceding embodiments, comprising two or more alternating (Sp)m (Rp)n.

665. The composition of any one of the preceding embodiments, comprising two or more alternating (Sp)2 (Rp).

666. The composition of any one of the preceding embodiments, wherein 50% or more of the chiral internucleotidic linkages in oligonucleotides of a first plurality have Sp configuration.

667. The composition of any one of the preceding embodiments, wherein 60% or more of the chiral internucleotidic linkages in oligonucleotides of a first plurality have Sp configuration.

668. The composition of any one of the preceding embodiments, wherein 70% or more of the chiral internucleotidic linkages in oligonucleotides of a first plurality have Sp configuration.

669. The composition of any one of the preceding embodiments, wherein 80% or more of the chiral internucleotidic linkages in oligonucleotides of a first plurality have Sp configuration.

670. The composition of any one of the preceding embodiments, wherein 90% or more of the chiral internucleotidic linkages in oligonucleotides of a first plurality have Sp configuration.

671. The composition of any one of the preceding embodiments, wherein each internucleotidic linkage in oligonucleotides of a first plurality is chiral, the core region has only one Rp, and each of the other internucleotidic linkages in oligonucleotides of a first plurality is Sp.

672. The composition of any one of the preceding embodiments, wherein the 5'-end internucleotidic linkage has an Rp configuration.

673. The composition of any one of embodiments 1-673, wherein the 5'-end internucleotidic linkage has an Sp configuration.

674. The composition of any one of the preceding embodiments, wherein the 3'-end internucleotidic linkage has an Sp configuration.

675. The composition of any one of embodiments 1-674, wherein the 3'-end internucleotidic linkage has an Sp configuration.

676. The composition of any one of the preceding embodiments, wherein oligonucleotides of the first plurality are blockmers.

677. The composition of any one of the preceding embodiments, wherein oligonucleotides of the first plurality are altmers.

678. The composition of any one of the preceding embodiments, wherein the oligonucleotide type is not (Sp, Sp, Rp, Sp, Sp, Rp, Sp, Sp, Rp, Sp, Sp)-d [5mCs1As1Gs1Ts15mCs1Ts1Gs15mCs1Ts1Ts15mCs1G] (SEQ ID NO: 1072) or (Rp, Rp, Rp, Rp, Rp, Sp, Sp, Rp, Sp, Sp, Rp, Sp, Sp, Rp, Rp, Rp, Rp, Rp, Rp)-Gs5mCs5mCsTs5mCsAsGsTs5mCsTsGs5mCsTsTs5mCs Gs5mCsAs5mCs5mC (SEQ ID NO: 1073) (5R-(SSR)3-5R), wherein in the underlined nucleotide are 2'-O-MOE modified.

679. The composition of any one of the preceding embodiments, wherein the oligonucleotide is not an oligonucleotide selected from: (Sp, Sp, Rp, Sp, Sp, Rp, Sp, Sp, Rp, Sp, Sp)-d [5mCs1As1Gs1Ts15mCs1Ts1Gs15mCs1Ts1Ts15mCs1G] (SEQ ID NO: 1072) or (Rp, Rp, Rp, Rp, Rp, Sp, Sp, Rp, Sp, Sp, Rp, Sp, Sp, Rp, Rp, Rp, Rp, Rp, Rp)-Gs5mCs5mCsTs5mCsAsGsTs5mCsTsGs5mCsTsTs5mCs Gs5mCsAs5mCs5mC (SEQ ID NO: 1073) (5R-(SSR)3-5R), wherein in the underlined nucleotide are 2'-O-MOE modified.

680. The composition of any one of the preceding embodiments, wherein the oligonucleotide is not an oligonucleotide selected from:

```
PCSK9 sense
ONT-106
                                   (SEQ ID NO: 1074)
(Rp)-uucuAGAccuGuuuuGcuudTsdT

PCSK9 sense
ONT-107
                                   (SEQ ID NO: 1075)
(Sp)-uucuAGAccuGuuuuGcuudTsdT
```

-continued

PCSK9 antisense
ONT-108
(SEQ ID NO: 1076)
(Rp)-AAGcAAAAcAGGUCuAGAAdTsdT

PCSK9 antisense
ONT-109
(SEQ ID NO: 1077)
(Sp)-AAGcAAAAcAGGUCuAGAAdTsdT

PCSK9 antisense
ONT-110
(SEQ ID NO: 1078)
(Rp, Rp)-asAGcAAAAcAGGUCuAGAAdTsdT

PCSK9 antisense
ONT-111
(SEQ ID NO: 1079)
(Sp, Rp)-asGcAAAAcAGGUCuAGAAdTsdT

PCSK9 antisense
ONT-112
(SEQ ID NO: 1080)
(Sp, Sp)-asGcAAAAcAGGUCuAGAAdTsdT

PCSK9 antisense
ONT-113
(SEQ ID NO: 1081)
(Rp, Sp)-asGcAAAAcAGGUCuAGAAdTsdT wherein lower case letters represent 2'OMe RNA residues; capital letters represent 2'OH RNA residues; and bolded and "s" indicates a phosphorothioate moiety; and PCSK9 (1)
(SEQ ID NO: 1082)
(All (Sp))-ususcsusAsGsAscscsusGsusususGscsususd TsdT PCSK9 (2)
(SEQ ID NO: 1083)
(All (Rp))-ususcsusAsGsAscscsusGsusususGscsususd TsdT PCSK9 (3)
(SEQ ID NO: 1084)
(All (Sp))-usucuAsGsAsccuGsuuuuGscuusdTsdT PCSK9 (4)
(SEQ ID NO: 1085)
(All (Rp))-usucuAsGsAsccuGsuuuuGscuusdTsdT PCSK9 (5)
(SEQ ID NO: 1086)
(Rp, Sp, Rp, Sp, Rp, Sp, Rp, Sp, Rp, Sp, Rp, Sp, Rp, Sp, Rp, Sp, Rp, Sp, Rp, Sp)-ususcsusAsGsAscscs usGsusususGscsususdTsdT PCSK9 (6)
(SEQ ID NO: 1087)
(Sp, Rp, Sp, Rp, Sp, Rp, Sp, Rp, Sp, Rp, Sp, Rp, Sp, Rp, Sp, Rp, Sp, Rp, Sp, Rp)-ususcsusAsGsAscscs usGsusususGscsususdTsdT wherein lower case letters represent 2'-OMe RNA residues; capital letters represent RNA residues; d=2'-deoxy residues; and "s" indicates a phosphorothioate moiety; and PCSK9 (7)
(SEQ ID NO: 1088)
(All (Rp))-AsAsGscsAsAsAsAscsAsGsGsUsCsusAsGsAsAsd TsdT PCSK9 (8)
(SEQ ID NO: 1089)
(All (Sp))-AsAsGscsAsAsAsAscsAsGsGsUsCsusAsGsAsAsd TsdT PCSK9 (9)
(SEQ ID NO: 1090)
(All (Rp))-AsAGcAAAAcsAsGsGsUsCsusAsGsAsAsdTsdT PCSK9 (10)
(SEQ ID NO: 1091)
(All (Sp))-AsAGcAAAAcsAsGsGsUsCsusAsGsAsAsdTsdT PCSK9 (11)
(SEQ ID NO: 1092)
(All (Rp))-AAsGscsAsAsAsAscAGGUCuAGAAdTsdT seq PCSK9 (12)
(SEQ ID NO: 1093)
(All (Sp))-AAsGscsAsAsAsAscAGGUCuAGAAdTsdT PCSK9 (13)
(SEQ ID NO: 1094)
(All (Rp))-AsAsGscAsAsAsAscAsGsGsUsCsuAsGsAsAsdTsd T PCSK9 (14)
(SEQ ID NO: 1095)
(All (Sp))-AsAsGscAsAsAsAscAsGsGsUsCsuAsGsAsAsdTsd T PCSK9 (15)
(SEQ ID NO: 1096)
(All (Rp))-AsAGcAAAsAscAsGsGsUsCsusAsGsAsAsdTsdT PCSK9 (16)
(SEQ ID NO: 1097)
(All (Sp))-AsAGcAAAsAscAsGsGsUsCsusAsGsAsAsdTsdT PCSK9 (17)
(SEQ ID NO: 1098)
(Rp, Sp, Rp, Sp, Rp, Sp, Rp, Sp, Rp, Sp, Rp, Sp, Rp, Sp)-AsAGcAAAsAscAsGsGsUsCsusAsGsAsAsdTsdT PCSK9 (18)
(SEQ ID NO: 1099)
(Sp, Rp, Sp, Rp, Sp, Rp, Sp, Rp, Sp, Rp, Sp, Rp, Sp, Rp)-AsAGcAAAsAscAsGsGsUsCsusAsGsAsAsdTsdT wherein lower case letters represent 2'-OMe RNA residues; capital letters represent RNA residues; d=2'-deoxy residues; "s" indicates a phosphorothioate moiety; and PCSK9 (19)
(SEQ ID NO: 1100)
(All (Rp))-UfsusCfsusAfsgsAfscsCfsusGfsusUfsusUfsg sCfsusUfsdTsdT PCSK9 (20)
seq 1101)
(All (Sp))-UfsusCfsusAfsgsAfscsCfsusGfsusUfsusUfsg sCfsusUfsdTsdT -continued PCSK9 (21)
(SEQ ID NO: 1102)
(All (Rp))-UfsuCfsuAfsgAfscCfsuGfsuUfsuUfsgCfsuUfs
dTsdT PCSK9 (22)
(SEQ ID NO: 1103)
(All (Sp))-UfsuCfsuAfsgAfscCfsuGfsuUfsuUfsgCfsuUfs
dTsdT PCSK9 (23)
(SEQ ID NO: 1104)
(Rp, Sp, Rp, Sp, Rp, Sp, Rp, Sp, Rp, Sp, Rp, Sp,
Rp, Sp, Rp, Sp, Rp, Sp, Rp, Sp)-UfsusCfsusAfsgsAfs
csCfsusGfsusUfsusUfsgsCfsusUfsdTsdT PCSK9 (24)
(SEQ ID NO: 1105)
(Sp, Rp, Sp, Rp, Sp, Rp, Sp, Rp, Sp, Rp, Sp, Rp,
Sp, Rp, Sp, Rp, Sp, Rp, Sp, Rp)-UfsusCfsusAfsgsAfs
csCfsusGfsusUfsusUfsgsCfsusUfsdTsdT wherein lower case letters represent 2'-OMe RNA residues; capital letters represent 2'-F RNA residues; d=2'-deoxy residues; and "s" indicates a phosphorothioate moiety; and PCSK9 (25)
(SEQ ID NO: 1106)
(All (Rp))-asAfsgsCfsasAfsasAfscsAfsgsGfsusCfsusAf
sgsAfsasdTsdT PCSK9 (26)
(SEQ ID NO: 1107)
(All (Sp))-asAfsgsCfsasAfsasAfscsAfsgsGfsusCfsusAf
sgsAfsasdTsdT PCSK9 (27)
(SEQ ID NO: 1108)
(All (Rp))-asAfgCfaAfaAfcsAfsgsGfsusCfsusAfsgsAfsa
sdTsdT PCSK9 (28)
(SEQ ID NO: 1109)
(All (Sp))-asAfgCfaAfaAfcsAfsgsGfsusCfsusAfsgsAfsa
sdTsdT PCSK9 (29)
(SEQ ID NO: 1110)
(All (Rp))-asAfsgCfsaAfsaAfscAfsgGfsuCfsuAfsgAfsad
TsdT PCSK9 (30)
(SEQ ID NO: 1111)
(All (Sp))-asAfsgCfsaAfsaAfscAfsgGfsuCfsuAfsgAfsad
TsdT PCSK9 (31)
(SEQ ID NO: 1112)
(Rp, Sp, Rp, Sp, Rp, Sp, Rp, Sp, Rp, Sp, Rp, Sp,
Rp, Sp)-asAfgCfaAfasAfscAfsgsGfsusCfsusAfsgsAfsasd
TsdT -continued PCSK9 (32)
(SEQ ID NO: 1113)
(Sp, Rp, Sp, Rp, Sp, Rp, Sp, Rp, Sp, Rp, Sp, Rp,
Sp, Rp)-asAfgCfaAfasAfscAfsgsGfsusCfsusAfsgsAfsasd
TsdT 681. The composition of any one of the preceding embodiments, wherein the oligonucleotide is not an oligonucleotide selected from:

682. d[$A_RC_SA_RC_SA_RC_SA_RC_SA_RC$] (SEQ ID NO: 1114), d[$C_SC_SC_SC_RC_RC_SC_SC_SC_SC$] (SEQ ID NO: 1115), d[$C_SC_SC_SC_SC_SC_RC_RC_SC$] (SEQ ID NO: 1116) and d[$C_SC_SC_SC_SC_SC_RC_RC_SC_SC$] (SEQ ID NO: 1117), wherein R is Rp phosphorothioate linkage, and S is Sp phosphorothioate linkage.

683. The composition of any one of the preceding embodiments, wherein the oligonucleotide is not an oligonucleotide selected from: $GGA_RT_SG_RT_ST_R{}^mC_STCGA$ (SEQ ID NO: 1118), $GGA_RT_RG_ST_ST_R{}^mC_RTCGA$ (SEQ ID NO: 1119), $GGA_ST_SG_RT_RT_S{}^mC_STCGA$ (SEQ ID NO: 1120), wherein R is Rp phosphorothioate linkage, S is Sp phosphorothioate linkage, all other linkages are PO, and each $^mC$ is a 5-methyl cytosine modified nucleoside.

684. The composition of any one of the preceding embodiments, wherein the oligonucleotide is not an oligonucleotide selected from: $T_kT_k{}^mC_kAGT{}^mCATGA{}^mCT_kT{}^mC_k{}^mC_k$ (SEQ ID NO: 31), wherein each nucleoside followed by a subscript 'k' indicates a (S)-cEt modification, R is Rp phosphorothioate linkage, S is Sp phosphorothioate linkage, each $^mC$ is a 5-methyl cytosine modified nucleoside, and all internucleoside linkages are phosphorothioates (PS) with stereochemistry patterns selected from RSSSRSRRRS, RSSSSSSSSS, SRRSRSSSSR, SRSRSSRSSR, RRRSSSRSSS, RRRSRSSRSR, RRSSSRSRSR, SRSSSRSSSS, SSRRSSRSRS, SSSSSSRRSS, RRRSSRRRSR, RRRRSSSSRS, SRRSRRRRRR, RSSRSSRRRR, RSRRSRRSRR, RRSRSSRSRS, SSRRRRRSRR, RSRRSRSSSR, RRSSRSRRRR, RRSRSRRSSS, RRSRSSSRRR, RSRRRRSRSR, SSRSSSRRRS, RSSRSRSRSR, RSRSRSSRSS, RRRSSRRSRS, SRRSSRRSRS, RRRRSRSRRR, SSSSRRRRSR, RRRRRRRRRR and SSSSSSSSSS.

685. The composition of any one of the preceding embodiments, wherein the oligonucleotide is not an oligonucleotide selected from: $T_kT_k{}^mC_k\underline{AGT{}^mCATGA{}^mCTT}_k{}^mC_k{}^mC_k$ (SEQ ID NO: 32), wherein each nucleoside followed by a subscript 'k' indicates a (S)-cEt modification, R is Rp phosphorothioate linkage, S is Sp phosphorothioate linkage, each $^mC$ is a 5-methyl cytosine modified nucleoside and all internucleoside linkages in the underlined core are phosphorothioates (PS) with stereochemistry patterns selected from: RSSSRSRRRS, RSSSSSSSSS, SRRSRSSSSR, SRSRSSRSSR, RRRSSSRSSS, RRRSRSSRSR, RRSSSRSRSR, SRSSSRSSSS, SSRRSSRSRS, SSSSSSRRSS, RRRSSRRRSR, RRRRSSSSRS, SRRSRRRRRR, RSSRSSRRRR, RSRRSRRSRR, RRSRSSRSRS, SSRRRRRSRR, RSRRSRSSSR, RRSSRSRRRR, RRSRSRRSSS, RRSRSSSRRR, RSRRRRSRSR, SSRSSSRRRS, RSSRSRSRSR, RSRSRSSRSS, RRRSSRRSRS, SRRSSRRSRS, RRRRSRSRRR, SSSSRRRRSR, RRRRRRRRRR and SSSSSSSSSS.

686. The composition of embodiment 684 or 685, wherein each phosphorothioate moiety of each nucleotide comprising (S)-cEt modification is stereorandom.

687. The composition of any one of the preceding embodiments, wherein oligonucleotides of a first plurality comprise two or more natural phosphate linkages.

688. The composition of any one of the preceding embodiments, wherein oligonucleotides of a first plurality comprise three or more natural phosphate linkages.

689. The composition of any one of the preceding embodiments, wherein oligonucleotides of a first plurality comprise four or more natural phosphate linkages.

690. The composition of any one of the preceding embodiments, wherein oligonucleotides of a first plurality comprise five or more natural phosphate linkages.

691. The composition of any one of the preceding embodiments, wherein oligonucleotides of a first plurality comprise six or more natural phosphate linkages.

692. The composition of any one of the preceding embodiments, wherein oligonucleotides of a first plurality comprise seven or more natural phosphate linkages.

693. The composition of any one of the preceding embodiments, wherein oligonucleotides of a first plurality comprise eight or more natural phosphate linkages.

694. The composition of any one of the preceding embodiments, wherein oligonucleotides of a first plurality comprise nine or more natural phosphate linkages.

695. The composition of any one of the preceding embodiments, wherein oligonucleotides of a first plurality comprise ten or more natural phosphate linkages.

696. The composition of any one of the preceding embodiments, wherein oligonucleotides of a first plurality comprise two or more modified phosphate linkages.

697. The composition of any one of the preceding embodiments, wherein oligonucleotides of a first plurality comprise three or more modified phosphate linkages.

698. The composition of any one of the preceding embodiments, wherein oligonucleotides of a first plurality comprise four or more modified phosphate linkages.

699. The composition of any one of the preceding embodiments, wherein oligonucleotides of a first plurality comprise five or more modified phosphate linkages.

700. The composition of any one of the preceding embodiments, wherein oligonucleotides of a first plurality comprise six or more modified phosphate linkages.

701. The composition of any one of the preceding embodiments, wherein oligonucleotides of a first plurality comprise seven or more modified phosphate linkages.

702. The composition of any one of the preceding embodiments, wherein oligonucleotides of a first plurality comprise eight or more modified phosphate linkages.

703. The composition of any one of the preceding embodiments, wherein oligonucleotides of a first plurality comprise nine or more modified phosphate linkages.

704. The composition of any one of the preceding embodiments, wherein oligonucleotides of a first plurality comprise ten or more modified phosphate linkages.

705. The composition of any one of embodiments 696-704, wherein each modified phosphate linkage is a phosphorothioate linkage.

706. The composition of any one of the preceding embodiments, wherein a first plurality of oligonucleotides comprises a modified base.

707. The composition of any one of the preceding embodiments, wherein a first plurality of oligonucleotides comprises a modified base, wherein a modified base is substituted A, T, C, U or G.

708. The composition of any one of the preceding embodiments, wherein each base moiety in an oligonucleotide of the first plurality is independently selected from A, T, C, U, 5-MeC and G.

709. The composition of any one of the preceding embodiments, wherein at least one chiral internucleotidic linkage is formed with greater than 90:10 diastereomeric selectivity.

710. The composition of any one of the preceding embodiments, wherein each chiral internucleotidic linkage is formed with greater than 90:10 diastereomeric selectivity.

711. The composition of any one of the preceding embodiments, wherein each chiral internucleotidic linkage is formed with greater than 95:5 diastereomeric selectivity.

712. The composition of any one of the preceding embodiments, wherein each chiral internucleotidic linkage is formed with greater than 96:4 diastereomeric selectivity.

713. The composition of any one of the preceding embodiments, wherein each chiral internucleotidic linkage is formed with greater than 97:3 diastereomeric selectivity.

714. The composition of any one of the preceding embodiments, wherein each chiral internucleotidic linkage is formed with greater than 98:2 diastereomeric selectivity.

715. The composition of any one of the preceding embodiments, wherein each chiral internucleotidic linkage is formed with greater than 98:2 diastereomeric selectivity.

716. The composition of any one of embodiments 710-715, wherein the diastereomeric selectivity for forming a chiral internucleotidic linkage is measured by forming a dimeric oligonucleotide comprising the chiral internucleotidic linkage and the nucleosides to both sides of the chiral 717. The composition of any one of the preceding embodiments, wherein base sequence of oligonucleotides of the first plurality is or comprises a sequence selected from Table ES3.

718. The composition of any one of the preceding embodiments, wherein base sequence of oligonucleotides of the first plurality is or comprises a sequence selected from Table ES1.

719. The composition of any one of the preceding embodiments, wherein base sequence of oligonucleotides of the first plurality is or comprises a sequence selected from Tables 1-4.

720. The composition of any one of the preceding embodiments, wherein base sequence of oligonucleotides of the first plurality is or comprises UCAAGGAAGAUGGCAUUUCU (SEQ ID NO: 54).

721. The composition of any one of the preceding embodiments, wherein base sequence of oligonucleotides of the first plurality is or comprises a sequence complementary to a sequence in dystrophin pre-mRNA which sequence comprises 10, 11, 12, 13, 14, 15, 16, 17, 18, 19, 20, 21, 22, 23, 24 or 25 nucleobases.

722. The composition of any one of the preceding embodiments, the oligonucleotide composition being characterized in that, when it is contacted with the transcript in a transcript splicing system, splicing of the transcript is altered relative to that observed under reference conditions selected from the group consisting of absence of the composition, presence of a reference composition, and combinations thereof, wherein the transcript is a pre-mRNA, and a splicing product is an mRNA.

723. The composition of any one of the preceding embodiments, wherein relative levels of one or more splicing products are changed.

724. The composition of any one of the preceding embodiments, wherein levels of one or more splicing products are increased.

725. The composition of any one of the preceding embodiments, wherein levels of one or more splicing products are decreased.

726. The composition of any one of the preceding embodiments, wherein level and/or activity of a polypeptide encoded by the transcript is reduced relative to that observed under reference conditions.

727. The composition of any one of the preceding embodiments, wherein level of a truncated form of a polypeptide encoded by the transcript is increased.

728. The composition of any one of the preceding embodiments, wherein level of a truncated form of a polypeptide encoded by the transcript is decreased.

729. The composition of any one of the preceding embodiments, wherein level of a lengthened form of a polypeptide encoded by the transcript is increased.

730. The composition of any one of the preceding embodiments, wherein level of a lengthened form of a polypeptide encoded by the transcript is decreased.

731. The composition of any one of the preceding embodiments, wherein relative and/or absolute levels of two or more different splice forms of a polypeptide encoded by the transcript are modified.

732. The composition of any one of the preceding embodiments, wherein the common base sequence of oligonucleotides of the first plurality is or comprises a sequence found in an intron of the target transcript.

733. The composition of any one of the preceding embodiments, wherein the common base sequence of oligonucleotides of the first plurality is a sequence found in an intron of the target transcript.

734. The composition of any one of the preceding embodiments, wherein the common base sequence of oligonucleotides of the first plurality is or comprises a sequence found in an exon of the target transcript.

735. The composition of any one of embodiments 1-732, wherein the common base sequence of oligonucleotides of the first plurality is a sequence found in an exon of the target transcript.

736. The composition of any one of the preceding embodiments, wherein the common base sequence of oligonucleotides of the first plurality is or comprises a sequence comprising a splicing site of the target transcript.

737. The composition of any one of embodiments 1-732, wherein the common base sequence of oligonucleotides of the first plurality is a sequence comprising a splicing site of the target transcript.

738. The composition of any one of the preceding embodiments, wherein the target transcript is dystrophin pre-mRNA.

739. The composition of any one of the preceding embodiments, wherein the target transcript is dystrophin pre-mRNA, and oligonucleotides of the first plurality increase the level of a splicing product of the dystrophin pre-mRNA, wherein an exon is skipped.

740. The composition of embodiment 739, wherein exon 51, 53, 45, 50, 44, 52, 55, or 8 is skipped.

741. The composition of embodiment 739, wherein exon 51 is skipped.

742. The composition of any one of embodiments 1-737, wherein the target transcript is MSTN pre-mRNA.

743. The composition of embodiment 742, wherein the target transcript is MSTN pre-mRNA, and oligonucleotides of the first plurality increase the level of a splicing product of the MSTN pre-mRNA, wherein an exon is skipped.

744. The composition of embodiment 743, wherein exon 2 of MSTN is skipped.

745. The composition of any one of the preceding embodiments, wherein oligonucleotides of the first plurality have a pre-determined level and comprises one or more chirally controlled internucleotidic linkages, and the reference condition is absence of the composition.

746. The composition of any one of the preceding embodiments, wherein oligonucleotides of the first plurality have a pre-determined level and comprises one or more chirally controlled internucleotidic linkages, and the reference condition is absence of the composition and presence of a reference composition.

747. The composition of embodiment 746, wherein a reference composition comprises a reference plurality of oligonucleotides, wherein oligonucleotides of the reference plurality differ from oligonucleotides of the first plurality only in that oligonucleotides of the reference plurality contain no chirally controlled internucleotidic linkages.

748. The composition of any one of embodiments 745-746, wherein the composition is chirally controlled.

749. The composition of any one of embodiments 745-746, wherein the composition is chirally controlled, and the reference composition differs from the composition only in that the reference composition is not chirally controlled.

750. The composition of any one of the preceding embodiments, wherein the oligonucleotides of the first plurality comprise a base modification pattern of an oligonucleotide selected from Tables 1-4.

751. The composition of any one of the preceding embodiments, wherein the oligonucleotides of the first plurality comprise a sugar modification pattern of an oligonucleotide selected from Tables 1-4.

752. The composition of any one of the preceding embodiments, wherein the oligonucleotides of the first plurality comprise an internucleotidic linkage modification pattern of an oligonucleotide selected from Tables 1-4.

753. The composition of any one of the preceding embodiments, wherein the oligonucleotides of the first plurality comprise an internucleotidic linkage stereochemistry pattern of an oligonucleotide selected from Tables 1-4.

754. The composition of any one of the preceding embodiments, further comprising one or more lipids.

755. The composition of any one of the preceding embodiments, further comprising one or more lipids, wherein at least one lipid is conjugated to an oligonucleotide.

756. The composition of any one of the preceding embodiments, wherein one or more oligonucleotides of the first plurality are conjugated to one or more lipids.

757. The composition of any one of the preceding embodiments, wherein each oligonucleotide of the first plurality is independently conjugated to one or more lipids.

758. The composition of any one of the preceding embodiments, wherein oligonucleotides of the first plurality are oligonucleotides of WV-887, WV-892, WV-896, WV-1714, WV-2444, WV-2445, WV-2526, WV-2527, WV-2528, WV-2530, WV-2531, WV-2578, WV-2580, WV-2587, WV-3047, WV-3152, WV-3472, WV-3473, WV-3507, WV-3508, WV-3509, WV-3510, WV-3511, WV-3512, WV-3513, WV-3514, WV-3515, WV-3545, or WV-3546.

759. A chirally controlled oligonucleotide composition of WV-887.

760. A chirally controlled oligonucleotide composition of WV-892.

761. A chirally controlled oligonucleotide composition of WV-896.

762. A chirally controlled oligonucleotide composition of WV-1714.

763. A chirally controlled oligonucleotide composition of WV-2444.

764. A chirally controlled oligonucleotide composition of WV-2445.

765. A chirally controlled oligonucleotide composition of WV-2526.

766. A chirally controlled oligonucleotide composition of WV-2527.

767. A chirally controlled oligonucleotide composition of WV-2528.

768. A chirally controlled oligonucleotide composition of WV-2530.

769. A chirally controlled oligonucleotide composition of WV-2531.

770. A chirally controlled oligonucleotide composition of WV-2578.

771. A chirally controlled oligonucleotide composition of WV-2580.

772. A chirally controlled oligonucleotide composition of WV-2587.

773. A chirally controlled oligonucleotide composition of WV-3047.

774. A chirally controlled oligonucleotide composition of WV-3152.

775. A chirally controlled oligonucleotide composition of WV-3472.

776. A chirally controlled oligonucleotide composition of WV-3473.

777. A chirally controlled oligonucleotide composition of WV-3507.

778. A chirally controlled oligonucleotide composition of WV-3508.

779. A chirally controlled oligonucleotide composition of WV-3509.

780. A chirally controlled oligonucleotide composition of WV-3510.

781. A chirally controlled oligonucleotide composition of WV-3511.

782. A chirally controlled oligonucleotide composition of WV-3512.

783. A chirally controlled oligonucleotide composition of WV-3513.

784. A chirally controlled oligonucleotide composition of WV-3514.

785. A chirally controlled oligonucleotide composition of WV-3515.

786. A chirally controlled oligonucleotide composition of WV-3545.

787. A chirally controlled oligonucleotide composition of WV-3546.

788. A composition comprising a chirally controlled oligonucleotide composition of an oligonucleotide selected from: WV-887, WV-892, WV-896, WV-1714, WV-2444, WV-2445, WV-2526, WV-2527, WV-2528, WV-2530, WV-2531, WV-2578, WV-2580, WV-2587, WV-3047, WV-3152, WV-3472, WV-3473, WV-3507, WV-3508, WV-3509, WV-3510, WV-3511, WV-3512, WV-3513, WV-3514, WV-3515, WV-3545, and WV-3546.

789. A composition comprising a chirally controlled oligonucleotide composition of an oligonucleotide wherein the sequence of the oligonucleotide comprises or consists of the sequence of an oligonucleotide selected from: WV-887, WV-892, WV-896, WV-1714, WV-2444, WV-2445, WV-2526, WV-2527, WV-2528, WV-2530, WV-2531, WV-2578, WV-2580, WV-2587, WV-3047, WV-3152, WV-3472, WV-3473, WV-3507, WV-3508, WV-3509, WV-3510, WV-3511, WV-3512, WV-3513, WV-3514, WV-3515, WV-3545, and WV-3546.

790. A chirally controlled oligonucleotide composition, wherein the sequence of the oligonucleotide comprises the sequence of WV-887.

791. A chirally controlled oligonucleotide composition, wherein the sequence of the oligonucleotide comprises the sequence of WV-892.

792. A chirally controlled oligonucleotide composition, wherein the sequence of the oligonucleotide comprises the sequence of WV-896.

793. A chirally controlled oligonucleotide composition, wherein the sequence of the oligonucleotide comprises the sequence of WV-1714.

794. A chirally controlled oligonucleotide composition, wherein the sequence of the oligonucleotide comprises the sequence of WV-2444.

795. A chirally controlled oligonucleotide composition, wherein the sequence of the oligonucleotide comprises the sequence of WV-2445.

796. A chirally controlled oligonucleotide composition, wherein the sequence of the oligonucleotide comprises the sequence of WV-2526.

797. A chirally controlled oligonucleotide composition, wherein the sequence of the oligonucleotide comprises the sequence of WV-2527.

798. A chirally controlled oligonucleotide composition, wherein the sequence of the oligonucleotide comprises the sequence of WV-2528.

799. A chirally controlled oligonucleotide composition, wherein the sequence of the oligonucleotide comprises the sequence of WV-2530.

800. A chirally controlled oligonucleotide composition, wherein the sequence of the oligonucleotide comprises the sequence of WV-2531.

801. A chirally controlled oligonucleotide composition, wherein the sequence of the oligonucleotide comprises the sequence of WV-2578.

802. A chirally controlled oligonucleotide composition, wherein the sequence of the oligonucleotide comprises the sequence of WV-2580.

803. A chirally controlled oligonucleotide composition, wherein the sequence of the oligonucleotide comprises the sequence of WV-2587.

804. A chirally controlled oligonucleotide composition, wherein the sequence of the oligonucleotide comprises the sequence of WV-3047.

805. A chirally controlled oligonucleotide composition, wherein the sequence of the oligonucleotide comprises the sequence of WV-3152.

806. A chirally controlled oligonucleotide composition, wherein the sequence of the oligonucleotide comprises the sequence of WV-3472.

807. A chirally controlled oligonucleotide composition, wherein the sequence of the oligonucleotide comprises the sequence of WV-3473.

808. A chirally controlled oligonucleotide composition, wherein the sequence of the oligonucleotide comprises the sequence of WV-3507.

809. A chirally controlled oligonucleotide composition, wherein the sequence of the oligonucleotide comprises the sequence of WV-3508.

810. A chirally controlled oligonucleotide composition, wherein the sequence of the oligonucleotide comprises the sequence of WV-3509.

811. A chirally controlled oligonucleotide composition, wherein the sequence of the oligonucleotide comprises the sequence of WV-3510.

812. A chirally controlled oligonucleotide composition, wherein the sequence of the oligonucleotide comprises the sequence of WV-3511.

813. A chirally controlled oligonucleotide composition, wherein the sequence of the oligonucleotide comprises the sequence of WV-3512.

814. A chirally controlled oligonucleotide composition, wherein the sequence of the oligonucleotide comprises the sequence of WV-3513.

815. A chirally controlled oligonucleotide composition, wherein the sequence of the oligonucleotide comprises the sequence of WV-3514.

816. A chirally controlled oligonucleotide composition, wherein the sequence of the oligonucleotide comprises the sequence of WV-3515.

817. A chirally controlled oligonucleotide composition, wherein the sequence of the oligonucleotide comprises the sequence of WV-3545.

818. A chirally controlled oligonucleotide composition, wherein the sequence of the oligonucleotide comprises the sequence of WV-3546.

819. A chirally controlled oligonucleotide composition, wherein the sequence of the oligonucleotide consists of the sequence of WV-887.

820. A chirally controlled oligonucleotide composition, wherein the sequence of the oligonucleotide consists of the sequence of WV-892.

821. A chirally controlled oligonucleotide composition, wherein the sequence of the oligonucleotide consists of the sequence of WV-896.

822. A chirally controlled oligonucleotide composition, wherein the sequence of the oligonucleotide consists of the sequence of WV-1714.

823. A chirally controlled oligonucleotide composition, wherein the sequence of the oligonucleotide consists of the sequence of WV-2444.

824. A chirally controlled oligonucleotide composition, wherein the sequence of the oligonucleotide consists of the sequence of WV-2445.

825. A chirally controlled oligonucleotide composition, wherein the sequence of the oligonucleotide consists of the sequence of WV-2526.

826. A chirally controlled oligonucleotide composition, wherein the sequence of the oligonucleotide consists of the sequence of WV-2527.

827. A chirally controlled oligonucleotide composition, wherein the sequence of the oligonucleotide consists of the sequence of WV-2528.

828. A chirally controlled oligonucleotide composition, wherein the sequence of the oligonucleotide consists of the sequence of WV-2530.

829. A chirally controlled oligonucleotide composition, wherein the sequence of the oligonucleotide consists of the sequence of WV-2531.

830. A chirally controlled oligonucleotide composition, wherein the sequence of the oligonucleotide consists of the sequence of WV-2578.

831. A chirally controlled oligonucleotide composition, wherein the sequence of the oligonucleotide consists of the sequence of WV-2580.

832. A chirally controlled oligonucleotide composition, wherein the sequence of the oligonucleotide consists of the sequence of WV-2587.

833. A chirally controlled oligonucleotide composition, wherein the sequence of the oligonucleotide consists of the sequence of WV-3047.

834. A chirally controlled oligonucleotide composition, wherein the sequence of the oligonucleotide consists of the sequence of WV-3152.

835. A chirally controlled oligonucleotide composition, wherein the sequence of the oligonucleotide consists of the sequence of WV-3472.

836. A chirally controlled oligonucleotide composition, wherein the sequence of the oligonucleotide consists of the sequence of WV-3473.

837. A chirally controlled oligonucleotide composition, wherein the sequence of the oligonucleotide consists of the sequence of WV-3507.

838. A chirally controlled oligonucleotide composition, wherein the sequence of the oligonucleotide consists of the sequence of WV-3508.

839. A chirally controlled oligonucleotide composition, wherein the sequence of the oligonucleotide consists of the sequence of WV-3509.

840. A chirally controlled oligonucleotide composition, wherein the sequence of the oligonucleotide consists of the sequence of WV-3510.

841. A chirally controlled oligonucleotide composition, wherein the sequence of the oligonucleotide consists of the sequence of WV-3511.

842. A chirally controlled oligonucleotide composition, wherein the sequence of the oligonucleotide consists of the sequence of WV-3512.

843. A chirally controlled oligonucleotide composition, wherein the sequence of the oligonucleotide consists of the sequence of WV-3513.

844. A chirally controlled oligonucleotide composition, wherein the sequence of the oligonucleotide consists of the sequence of WV-3514.

845. A chirally controlled oligonucleotide composition, wherein the sequence of the oligonucleotide consists of the sequence of WV-3515.

846. A chirally controlled oligonucleotide composition, wherein the sequence of the oligonucleotide consists of the sequence of WV-3545.

847. A chirally controlled oligonucleotide composition, wherein the sequence of the oligonucleotide consists of the sequence of WV-3546.

848. A chirally controlled oligonucleotide composition, wherein the sequence of the oligonucleotide comprises or consists of the sequence of WV-887, wherein the composition further comprises a lipid.

849. A chirally controlled oligonucleotide composition, wherein the sequence of the oligonucleotide comprises or consists of the sequence of WV-892, wherein the composition further comprises a lipid.

850. A chirally controlled oligonucleotide composition, wherein the sequence of the oligonucleotide comprises or consists of the sequence of WV-896, wherein the composition further comprises a lipid.

851. A chirally controlled oligonucleotide composition, wherein the sequence of the oligonucleotide comprises or consists of the sequence of WV-1714, wherein the composition further comprises a lipid.

852. A chirally controlled oligonucleotide composition, wherein the sequence of the oligonucleotide comprises or consists of the sequence of WV-2444, wherein the composition further comprises a lipid.

853. A chirally controlled oligonucleotide composition, wherein the sequence of the oligonucleotide comprises or consists of the sequence of WV-2445, wherein the composition further comprises a lipid.

854. A chirally controlled oligonucleotide composition, wherein the sequence of the oligonucleotide comprises or consists of the sequence of WV-2526, wherein the composition further comprises a lipid.

855. A chirally controlled oligonucleotide composition, wherein the sequence of the oligonucleotide comprises or consists of the sequence of WV-2527, wherein the composition further comprises a lipid.

856. A chirally controlled oligonucleotide composition, wherein the sequence of the oligonucleotide comprises or consists of the sequence of WV-2528, wherein the composition further comprises a lipid.

857. A chirally controlled oligonucleotide composition, wherein the sequence of the oligonucleotide comprises or consists of the sequence of WV-2530, wherein the composition further comprises a lipid.

858. A chirally controlled oligonucleotide composition, wherein the sequence of the oligonucleotide comprises or consists of the sequence of WV-2531, wherein the composition further comprises a lipid.

859. A chirally controlled oligonucleotide composition, wherein the sequence of the oligonucleotide comprises or consists of the sequence of WV-2578, wherein the composition further comprises a lipid.

860. A chirally controlled oligonucleotide composition, wherein the sequence of the oligonucleotide comprises or consists of the sequence of WV-2580, wherein the composition further comprises a lipid.

861. A chirally controlled oligonucleotide composition, wherein the sequence of the oligonucleotide comprises or consists of the sequence of WV-2587, wherein the composition further comprises a lipid.

862. A chirally controlled oligonucleotide composition, wherein the sequence of the oligonucleotide comprises or consists of the sequence of WV-3047, wherein the composition further comprises a lipid.

863. A chirally controlled oligonucleotide composition, wherein the sequence of the oligonucleotide comprises or consists of the sequence of WV-3152, wherein the composition further comprises a lipid.

864. A chirally controlled oligonucleotide composition, wherein the sequence of the oligonucleotide comprises or consists of the sequence of WV-3472, wherein the composition further comprises a lipid.

865. A chirally controlled oligonucleotide composition, wherein the sequence of the oligonucleotide comprises or consists of the sequence of WV-3473, wherein the composition further comprises a lipid.

866. A chirally controlled oligonucleotide composition, wherein the sequence of the oligonucleotide comprises or consists of the sequence of WV-3507, wherein the composition further comprises a lipid.

867. A chirally controlled oligonucleotide composition, wherein the sequence of the oligonucleotide comprises or consists of the sequence of WV-3508, wherein the composition further comprises a lipid.

868. A chirally controlled oligonucleotide composition, wherein the sequence of the oligonucleotide comprises or consists of the sequence of WV-3509, wherein the composition further comprises a lipid.

869. A chirally controlled oligonucleotide composition, wherein the sequence of the oligonucleotide comprises or consists of the sequence of WV-3510, wherein the composition further comprises a lipid.

870. A chirally controlled oligonucleotide composition, wherein the sequence of the oligonucleotide comprises or consists of the sequence of WV-3511, wherein the composition further comprises a lipid.

871. A chirally controlled oligonucleotide composition, wherein the sequence of the oligonucleotide comprises or consists of the sequence of WV-3512, wherein the composition further comprises a lipid.

872. A chirally controlled oligonucleotide composition, wherein the sequence of the oligonucleotide comprises or consists of the sequence of WV-3513, wherein the composition further comprises a lipid.

873. A chirally controlled oligonucleotide composition, wherein the sequence of the oligonucleotide comprises or consists of the sequence of WV-3514, wherein the composition further comprises a lipid.

874. A chirally controlled oligonucleotide composition, wherein the sequence of the oligonucleotide comprises or consists of the sequence of WV-3515, wherein the composition further comprises a lipid.

875. The oligonucleotide composition of any one of embodiments 789-874, wherein the sequence of an oligonucleotide includes any one or more of: base sequence (including length), pattern of chemical modifications to sugar and base moieties, pattern of backbone linkages (e.g., pattern of natural phosphate linkages, phosphorothioate linkages, phosphorothioate triester linkages, and combinations thereof), pattern of backbone chiral centers (e.g., pattern of stereochemistry (Rp/Sp) of chiral internucleotidic linkages), and pattern of backbone phosphorus modifications (e.g., pattern of modifications on the internucleotidic phosphorus atom, such as —S—, and $-L-R^1$ of formula I).

876. The composition of any one of the preceding embodiments, wherein the lipid comprises an optionally substituted, $C_{10}$-$C_{80}$ saturated or partially unsaturated aliphatic group, wherein one or more methylene units are optionally and independently replaced by an optionally substituted group selected from $C_1$-$C_6$ alkylene, $C_1$-$C_6$ alkenylene, —C≡C—, a $C_1$-$C_6$ heteroaliphatic moiety, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, and —C(O)O—, wherein each variable is independently as defined and described herein.

877. The composition of any one of the preceding embodiments, wherein the lipid comprises an optionally substituted $C_{10}$-$C_{80}$ saturated or partially unsaturated, aliphatic chain.

878. The composition of any one of the preceding embodiments, wherein the lipid comprises an optionally substituted $C_{10}$-$C_{80}$ linear, saturated or partially unsaturated, aliphatic chain.

879. The composition of any one of the preceding embodiments, wherein the lipid comprises a $C_{10}$-$C_{80}$ linear, saturated or partially unsaturated, aliphatic chain, optionally substituted with one or more $C_{1-4}$ aliphatic group.

880. The composition of any one of the preceding embodiments, wherein the lipid comprises an optionally substituted, $C_{10}$-$C_{60}$ saturated or partially unsaturated aliphatic group, wherein one or more methylene units are optionally and independently replaced by an optionally substituted group selected from $C_1$-$C_6$ alkylene, $C_1$-$C_6$ alkenylene, —C≡C—, a $C_1$-$C_6$ heteroaliphatic moiety, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, and —C(O)O—, wherein each variable is independently as defined and described herein.

881. The composition of any one of the preceding embodiments, wherein the lipid comprises an optionally substituted $C_{10}$-$C_{60}$ saturated or partially unsaturated, aliphatic chain.

882. The composition of any one of the preceding embodiments, wherein the lipid comprises an optionally substituted $C_{10}$-$C_{60}$ linear, saturated or partially unsaturated, aliphatic chain.

883. The composition of any one of the preceding embodiments, wherein the lipid comprises a $C_{10}$-$C_{60}$ linear, saturated or partially unsaturated, aliphatic chain, optionally substituted with one or more $C_{1-4}$ aliphatic group.

884. The composition of any one of the preceding embodiments, wherein the lipid comprises an optionally substituted, $C_{10}$-$C_{40}$ saturated or partially unsaturated aliphatic group, wherein one or more methylene units are optionally and independently replaced by an optionally substituted group selected from $C_1$-$C_6$ alkylene, $C_1$-$C_6$ alkenylene, —C≡C—, a $C_1$-$C_6$ heteroaliphatic moiety, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, and —C(O)O—, wherein each variable is independently as defined and described herein.

885. The composition of any one of the preceding embodiments, wherein the lipid comprises an optionally substituted $C_{10}$-$C_{40}$ saturated or partially unsaturated, aliphatic chain.

886. The composition of any one of the preceding embodiments, wherein the lipid comprises an optionally substituted $C_{10}$-$C_{40}$ linear, saturated or partially unsaturated, aliphatic chain.

887. The composition of any one of the preceding embodiments, wherein the lipid comprises a $C_{10}$-$C_{40}$ linear, saturated or partially unsaturated, aliphatic chain, optionally substituted with one or more $C_{1-4}$ aliphatic group.

888. The composition of any one of the preceding embodiments, wherein the lipid comprises an unsubstituted $C_{10}$-$C_{80}$ linear, saturated or partially unsaturated, aliphatic chain.

889. The composition of any one of the preceding embodiments, wherein the lipid comprises no more than one optionally substituted $C_{10}$-$C_{60}$ linear, saturated or partially unsaturated, aliphatic chain.

890. The composition of any one of the preceding embodiments, wherein the lipid comprises two or more optionally substituted $C_{10}$-$C_{60}$ linear, saturated or partially unsaturated, aliphatic chain.

891. The composition of any one of the preceding embodiments, wherein the lipid comprises an unsubstituted $C_{10}$-$C_{60}$ linear, saturated or partially unsaturated, aliphatic chain.

892. The composition of any one of the preceding embodiments, wherein the lipid comprises no more than one optionally substituted $C_{10}$-$C_{60}$ linear, saturated or partially unsaturated, aliphatic chain.

893. The composition of any one of embodiments 1-891, wherein the lipid comprises two or more optionally substituted $C_{10}$-$C_{60}$ linear, saturated or partially unsaturated, aliphatic chain.

894. The composition of any one of the preceding embodiments, wherein the lipid comprises an unsubstituted $C_{10}$-$C_{40}$ linear, saturated or partially unsaturated, aliphatic chain.

895. The composition of any one of the preceding embodiments, wherein the lipid comprises no more than one optionally substituted $C_{10}$-$C_{40}$ linear, saturated or partially unsaturated, aliphatic chain.

896. The composition of any one of embodiments 1-894, wherein the lipid comprises two or more optionally substituted $C_{10}$-$C_{60}$ linear, saturated or partially unsaturated, aliphatic chain.

897. The composition of any one of the preceding embodiments, wherein the lipid comprises a $C_{10}$-$C_{40}$ linear, saturated or partially unsaturated, aliphatic chain.

898. The composition of any one of the preceding embodiments, wherein the lipid comprises a $C_{10}$-$C_{40}$ linear, saturated or partially unsaturated, aliphatic chain, optionally substituted with one or more $C_{1-4}$ aliphatic group.

899. The composition of any one of the preceding embodiments, wherein the lipid comprises an unsubstituted $C_{10}$-$C_{40}$ linear, saturated or partially unsaturated, aliphatic chain.

900. The composition of any one of the preceding embodiments, wherein the lipid has the structure $R^{LD}$—COOH or $R^{LD}$—OH.

901. The composition of any one of the preceding embodiments, wherein the lipid is selected from the group consisting of: lauric acid, myristic acid, palmitic acid, stearic acid, oleic acid, linoleic acid, alpha-linolenic acid, gamma-linolenic acid, docosahexaenoic acid (cis-DHA), turbinaric acid and dilinoleyl.

902. The composition of any one of the preceding embodiments, wherein the lipid is not conjugated to the oligonucleotide.

903. The composition of any one of the preceding embodiments, wherein the lipid is conjugated to the oligonucleotide.

904. The composition of any one of the preceding embodiments, wherein the lipid is conjugated to the oligonucleotide through a linker.

905. The composition of any one of the preceding embodiments, wherein the lipid is conjugated to the oligonucleotide with a linker, wherein the linker is -$L^{LD}$-.

906. The composition of any one of the preceding embodiments, wherein the lipid is conjugated to the oligonucleotide with a linker, wherein the linker is —NH—(CH$_2$)$_6$—.

907. The composition of any one of the preceding embodiments, wherein the lipid is conjugated to the oligonucleotide with a linker, wherein the linker is —C(O)—NH—(CH$_2$)$_6$—P(O)(O$^-$)—.

908. The composition of any one of the preceding embodiments, wherein the lipid is conjugated to the oligonucleotide with a linker, wherein the linker is —C(O)—NH—(CH$_2$)$_6$—P(O)(S$^-$)—.

909. The composition of embodiment 907 or 908, wherein the lipid is a fatty acid which is connected to the linker through formation of the amide group —C(O)—NH—, and the oligonucleotide is connected to the linker through formation of a phosphate or phosphorothioate linkage between its 5'-OH or 3'-OH with —P(O)(O$^-$)— or —P(O)(S$^-$)— of the linker.

910. The composition of embodiment 907 or 908, wherein the lipid is a fatty acid which is connected to the linker through formation of the amide group —C(O)—NH—, and the oligonucleotide is connected to the linker through formation of a phosphate or phosphorothioate linkage between its 5'-OH with —P(O)($O^-$)— or —P(O)($S^-$)— of the linker.

911. The composition of embodiment 907 or 908, wherein the lipid is a fatty acid which is connected to the linker through formation of the amide group —C(O)—NH—, and the oligonucleotide is connected to the linker through formation of a phosphate or phosphorothioate linkage between its 3'-OH with —P(O)($O^-$)— or —P(O)($S^-$)— of the linker.

912. The composition of any one of the preceding embodiments, further comprising one or more targeting components.

913. An oligonucleotide composition comprising a plurality of oligonucleotides having the structure of:

$$A^c\text{—}[L^{LD}\text{—}(R^{LD})_a]_b, \text{ or } [(A^c)_a\text{—}L^{LD}]_b\text{—}R^{LD},$$

wherein:

$A^c$ is an oligonucleotide chain ($[H]_b$-$A^c$ is an oligonucleotide);

a is 1-1000;

b is 1-1000;

each $L^{LD}$ is independently a linker moiety; and each $R^{LD}$ is independently a lipid moiety or a targeting component.

914. An oligonucleotide composition comprising a plurality of oligonucleotides having the structure of:

$$A^c\text{—}[L^{LD}\text{—}(R^{LD})_a]_b, \text{ or } [(A^c)_a\text{—}L^{LD}]_b\text{—}R^{LD},$$

wherein:

$A^c$ is an oligonucleotide chain ($[H]_b$-$A^c$ is an oligonucleotide);

a is 1-1000;

b is 1-1000;

each $L^{LD}$ is independently a covalent bond or an optionally substituted, $C_1$-$C_{50}$ saturated or partially unsaturated aliphatic group, wherein one or more methylene units are optionally and independently replaced by $T^{LD}$ or an optionally substituted group selected from $C_1$-$C_6$ alkylene, $C_1$-$C_6$ alkenylene, —C≡C—, a $C_1$-$C_6$ heteroaliphatic moiety, —C(R')$_2$—, —Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, and —C(O)O—;

each $R^{LD}$ is independently an optionally substituted, $C_1$-$C_{80}$ saturated or partially unsaturated aliphatic group, wherein one or more methylene units are optionally and independently replaced by an optionally substituted group selected from $C_1$-$C_6$ alkylene, $C_1$-$C_6$ alkenylene, —C≡C—, a $C_1$-$C_6$ heteroaliphatic moiety, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, and —C(O)O—;

$T^{LD}$ has the structure of:

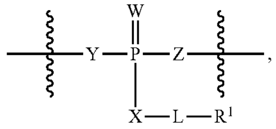

W is O, S or Se;

each of X, Y and Z is independently —O—, —S—, —N(-L-$R^1$)—, or L;

L is a covalent bond or an optionally substituted, linear or branched $C_1$-$C_{10}$ alkylene, wherein one or more methylene units of L are optionally and independently replaced by an optionally substituted group selected from $C_1$-$C_6$ alkylene, $C_1$-$C_6$ alkenylene, —C≡C—, a $C_1$-$C_6$ heteroaliphatic moiety, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$— —SC(O)—, —C(O)S—, —OC(O)—, and —C(O)O—;

$R^1$ is halogen, R, or an optionally substituted $C_1$-$C_{50}$ aliphatic wherein one or more methylene units are optionally and independently replaced by an optionally substituted group selected from $C_1$-$C_6$ alkylene, $C_1$-$C_6$ alkenylene, —C≡C—, a $C_1$-$C_6$ heteroaliphatic moiety, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$— —SC(O)—, —C(O)S—, —OC(O)—, and —C(O)O— each R' is independently —R, —C(O)R, —$CO_2$R, or —$SO_2$R, or:

two R' are taken together with their intervening atoms to form an optionally substituted aryl, carbocyclic, heterocyclic, or heteroaryl ring;

-Cy- is an optionally substituted bivalent ring selected from phenylene, carbocyclylene, arylene, heteroarylene, and heterocyclylene; and each R is independently hydrogen, or an optionally substituted group selected from $C_1$-$C_6$ aliphatic, carbocyclyl, aryl, heteroaryl, and heterocyclyl.

915. The composition of any one of embodiments 1-912, wherein the composition is a composition of any one of embodiments 913-914.

916. The composition of any one of embodiments 913-915, wherein the oligonucleotides or oligonucleotides have the structure of $A^c$-[-$L^{LD}$-$(R^{LD})_a]_b$.

917. The composition of any one of embodiments 913-915, wherein the oligonucleotides or oligonucleotides have the structure of $[(A^c)_a$-$L^{LD}]_b$-$R^{LD}$ 918. The composition of any one of embodiments 913-917, wherein $L^{LD}$, $R^{LD}$, combinations of $L^{LD}$ and $R^{LD}$, or -[-$L^{LD}$-$(R^{LD})_a]_b$ comprises one or more lipid moieties.

919. The composition of any one of embodiments 913-917, wherein -[-$L^{LD}$-$(R^{LD})_a]_b$ comprises one or more lipid moieties.

920. The composition of any one of embodiments 913-918, wherein $R^{LD}$ comprises one or more lipid moieties.

921. The composition of any one of embodiments 913-917, wherein $L^{LD}$, $R^{LD}$, combinations of $L^{LD}$ and $R^{LD}$, or -[-$L^{LD}$-$(R^{LD})_a]_b$ comprises one or more targeting components.

922. The composition of any one of embodiments 913-917, wherein -[-$L^{LD}$-$(R^{LD})_a]_b$ comprises one or more targeting components.

923. The composition of any one of embodiments 913-918, wherein $R^{LD}$ comprises one or more targeting components.

924. The composition of any one of embodiments 913-923, wherein b is 1.

925. The composition of any one of embodiments 913-924, wherein a is 1.

926. The composition of any one of embodiments 913-925, wherein $A^c$ comprises one or more modified base, sugar, or internucleotidic linkage moieties.

927. The composition of any one of embodiments 913-925, wherein $A^c$ comprises one or more chiral internucleotidic linkages.

928. The composition of any one of embodiments 913-925, wherein $A^c$ comprises one or more chiral internucleotidic linkages, and each chiral internucleotidic linkage of $A^c$ is chirally controlled.

929. The composition of any one of embodiments 913-925, wherein oligonucleotides having the structure of $A^c$-[-$L^{LD}$-$(R^{LD})_a]_b$, or $[(A^c)_a$-$L^{LD}]_b$-$R^{LD}$, are of a particular type defined by the 1) base sequence; 2) pattern of backbone linkages; 3) pattern of backbone chiral centers; and 4) pattern of backbone phosphorus modifications of $A^c$.

930. The composition of any one of embodiments 913-925, wherein $A^c$ is the oligonucleotide chain of any one of the preceding embodiments.

931. The composition of any one of embodiments 913-929, wherein $A^c$ is an oligonucleotide of any one of the preceding embodiments, connecting to $L^{LD}$ through a nucleobase.

932. The composition of any one of embodiments 913-929, wherein $A^c$ is an oligonucleotide of any one of the preceding embodiments, connecting to $L^{LD}$ through an internucleotidic linkage.

933. The composition of any one of embodiments 913-929, wherein $A^c$ is an oligonucleotide of any one of the preceding embodiments, connecting to $L^{LD}$ through a sugar moiety.

934. The composition of any one of embodiments 913-929, wherein $A^c$ is an oligonucleotide of any one of the preceding embodiments, connecting to $L^{LD}$ through a hydroxyl group of a sugar moiety (—O—).

935. The composition of any one of embodiments 913-925, wherein $A^c$ is an oligonucleotide of any one of the preceding embodiments, connecting to $L^{LD}$ through its 5'-O—.

936. The composition of any one of embodiments 913-935, wherein $A^c$ is an oligonucleotide described in any of the Tables.

937. The composition of any one of embodiments 913-935, wherein $A^c$ is WV-887 connected to $L^{LD}$ and $R^{LD}$ ($[H]_b$-$A^c$ is WV-887).

938. The composition of any one of embodiments 913-935, wherein $A^c$ is WV-892 connected to $L^{LD}$ and $R^{LD}$ ($[H]_b$-$A^c$ is WV-892).

939. The composition of any one of embodiments 913-935, wherein $A^c$ is WV-896 connected to $L^{LD}$ and $R^{LD}$ ($[H]_b$-$A^c$ is WV-896).

940. The composition of any one of embodiments 913-935, wherein $A^c$ is WV-1714 connected to $L^{LD}$ and $R^{LD}$ ($[H]_b$-$A^c$ is WV-1714).

941. The composition of any one of embodiments 913-935, wherein $A^c$ is WV-2444 connected to $L^{LD}$ and $R^{LD}$ ($[H]_b$-$A^c$ is WV-2444).

942. The composition of any one of embodiments 913-935, wherein $A^c$ is WV-2445 connected to $L^{LD}$ and $R^{LD}$ ($[H]_b$-$A^c$ is WV-2445).

943. The composition of any one of embodiments 913-935, wherein $A^c$ is WV-2526 connected to $L^{LD}$ and $R^{LD}$ ($[H]_b$-$A^c$ is WV-2526).

944. The composition of any one of embodiments 913-935, wherein $A^c$ is WV-2527 connected to $L^{LD}$ and $R^{LD}$ ($[H]_b$-$A^c$ is WV-2527).

945. The composition of any one of embodiments 913-935, wherein $A^c$ is WV-2528 connected to $L^{LD}$ and $R^{LD}$ ($[H]_b$-$A^c$ is WV-2528).

946. The composition of any one of embodiments 913-935, wherein $A^c$ is WV-2530 connected to $L^{LD}$ and $R^{LD}$ ($[H]_b$-$A^c$ is WV-2530).

947. The composition of any one of embodiments 913-935, wherein $A^c$ is WV-2531 connected to $L^{LD}$ and $R^{LD}$ ($[H]_b$-$A^c$ is WV-2531).

948. The composition of any one of embodiments 913-935, wherein $A^c$ is WV-2578 connected to $L^{LD}$ and $R^{LD}$ ($[H]_b$-$A^c$ is WV-2578).

949. The composition of any one of embodiments 913-935, wherein $A^c$ is WV-2580 connected to $L^{LD}$ and $R^{LD}$ ($[H]_b$-$A^c$ is WV-2580).

950. The composition of any one of embodiments 913-935, wherein $A^c$ is WV-2587 connected to $L^{LD}$ and $R^{LD}$ ($[H]_b$-$A^c$ is WV-2587).

951. The composition of any one of embodiments 913-935, wherein $A^c$ is WV-3047 connected to $L^{LD}$ and $R^{LD}$ ($[H]_b$-$A^c$ is WV-3047).

952. The composition of any one of embodiments 913-935, wherein $A^c$ is WV-3152 connected to $L^{LD}$ and $R^{LD}$ ($[H]_b$-$A^c$ is WV-3152).

953. The composition of any one of embodiments 913-935, wherein $A^c$ is WV-3472 connected to $L^{LD}$ and $R^{LD}$ ($[H]_b$-$A^c$ is WV-3472).

954. The composition of any one of embodiments 913-935, wherein $A^c$ is WV-3473 connected to $L^{LD}$ and $R^{LD}$ ($[H]_b$-$A^c$ is WV-3473).

955. The composition of any one of embodiments 913-935, wherein $A^c$ is WV-3507 connected to $L^{LD}$ and $R^{LD}$ ($[H]_b$-$A^c$ is WV-3507).

956. The composition of any one of embodiments 913-935, wherein $A^c$ is WV-3508 connected to $L^{LD}$ and $R^{LD}$ ($[H]_b$-$A^c$ is WV-3508).

957. The composition of any one of embodiments 913-935, wherein $A^c$ is WV-3509 connected to $L^{LD}$ and $R^{LD}$ ($[H]_b$-$A^c$ is WV-3509).

958. The composition of any one of embodiments 913-935, wherein $A^c$ is WV-3510 connected to $L^{LD}$ and $R^{LD}$ ($[H]_b$-$A^c$ is WV-3510).

959. The composition of any one of embodiments 913-935, wherein $A^c$ is WV-3511 connected to $L^{LD}$ and $R^{LD}$ ($[H]_b$-$A^c$ is WV-3511).

960. The composition of any one of embodiments 913-935, wherein $A^c$ is WV-3512 connected to $L^{LD}$ and $R^{LD}$ ($[H]_b$-$A^c$ is WV-3512).

961. The composition of any one of embodiments 913-935, wherein $A^c$ is WV-3513 connected to $L^{LD}$ and $R^{LD}$ ($[H]_b$-$A^c$ is WV-3513).

962. The composition of any one of embodiments 913-935, wherein $A^c$ is WV-3514 connected to $L^{LD}$ and $R^{LD}$ ($[H]_b$-$A^c$ is WV-3514).

963. The composition of any one of embodiments 913-935, wherein $A^c$ is WV-3515 connected to $L^{LD}$ and $R^{LD}$ ($[H]_b$-$A^c$ is WV-3515).

964. The composition of any one of embodiments 913-963, wherein $L^{LD}$ is an optionally substituted, $C_1$-$C_{10}$ saturated or partially unsaturated aliphatic group, wherein one or more methylene units are optionally and independently replaced by $T^{LD}$ or an optionally substituted group selected from $C_1$-$C_6$ alkylene, $C_1$-$C_6$ alkenylene, —C≡C—, a $C_1$-$C_6$ heteroaliphatic moiety, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, and —C(O)O—.

965. The composition of any one of embodiments 913-963, wherein $L^{LD}$ is an optionally substituted, $C_1$-$C_{10}$ saturated or partially unsaturated aliphatic group, wherein one or more methylene units are optionally and independently replaced by an optionally substituted group selected from $C_1$-$C_6$ alkylene, $C_1$-$C_6$ alkenylene, —C≡C—, -Cy-, —O—, —S—, —N(R')—, —C(O)—, —C(O)N(R')—, —N(R')C(O)N(R')—, —OC(O)N(R')—, —S(O)—, —S(O)$_2$—, —S(O)$_2$N(R')—, and —C(O)O—, or $T^{LD}$ wherein W is O or S, each of Y and Z is independently —O—, —S—, or -L-.

966. The composition of any one of embodiments 913-963, wherein $L^{LD}$ is an optionally substituted, $C_1$-$C_{10}$ saturated or partially unsaturated aliphatic group, wherein one or more methylene units are optionally and independently replaced by an optionally substituted group selected from $C_1$-$C_6$ alkylene, $C_1$-$C_6$ alkenylene, —C≡C—, -Cy-, —O—, —S—, —N(R')—, —C(O)—, —C(O)N(R')—, —N(R')C(O)N(R')—, —OC(O)N(R')—, —S(O)—, —S(O)$_2$—, —S(O)$_2$N(R')—, and —C(O)O—, or $T^{LD}$ wherein W is O or S, each of X and Y is independently —O—, —S—, or -L-, and Z is a covalent bond.

967. The composition of any one of embodiments 913-965, wherein $L^{LD}$ connects to a hydroxyl group of $A^c$.

968. The composition of any one of embodiments 913-965, wherein $L^{LD}$ connects to 5'-OH of $A^c$.

969. The composition of any one of embodiments 913-965, wherein $L^{LD}$ connects to 3'-OH of $A^c$.

970. The composition of any one of the preceding embodiments, wherein each R' is independently —R, —C(O)R, —$CO_2$R, or —$SO_2$R, or:

two R' are taken together with their intervening atoms to form an optionally substituted $C_3$-$C_{14}$ monocyclic, bicyclic or polycyclic aryl, carbocyclic, heterocyclic, or heteroaryl ring having 0-10 heteroatoms.

971. The composition of any one of the preceding embodiments, wherein -Cy- is an optionally substituted bivalent ring selected from $C_3$-$C_{14}$ monocyclic, bicyclic or polycyclic carbocyclylene, arylene, heteroarylene, and heterocyclylene having 0-10 heteroatoms.

972. The composition of any one of the preceding embodiments, wherein each R is independently hydrogen, or an optionally substituted group selected from $C_1$-$C_6$ aliphatic, and $C_3$-$C_{14}$ monocyclic, bicyclic or polycyclic aryl, carbocyclic, heterocyclic, or heteroaryl ring having 0-10 heteroatoms.

973. The composition of any one of embodiments 913-965, wherein $L^{LD}$ is $T^{LD}$.

974. The composition of any one of embodiments 913-965, wherein $L^{LD}$ is —NH—(CH$_2$)$_6$-$T^{LD}$-.

975. The composition of any one of embodiments 913-965, wherein $L^{LD}$ is —C(O)—NH—(CH$_2$)$_6$-$T^{LD}$-.

976. The composition of embodiment 975, wherein —C(O)— is connected to —$R^{LD}$.

977. The composition of any one of embodiments 913-976, wherein $T^{LD}$ is connected to 5'-O— or 3'-O— of $A^c$.

978. The composition of any one of embodiments 913-977, wherein $T^{LD}$ is connected to 5'-O— of $A^c$.

979. The composition of any one of embodiments 913-977, wherein $T^{LD}$ is connected to 3'-O— of $A^c$.

980. The composition of any one of embodiments 913-979, wherein $T^{LD}$ forms a phosphorothioate linkage with 5'-O— or 3'-O— of $A^c$.

981. The composition of embodiment 980, wherein a phosphorothioate linkage is chirally controlled and is Sp.

982. The composition of embodiment 980, wherein a phosphorothioate linkage is chirally controlled and is Rp.

983. The composition of any one of embodiments 913-979, wherein $T^{LD}$ forms a phosphate linkage with 5'-O— or 3'-O— of $A^c$.

984. The composition of any one of embodiments 913-963, wherein $L^{LD}$ is a covalent bond.

985. The composition of any one of the preceding embodiments, $R^{LD}$ is an optionally substituted, $C_{10}$-$C_{80}$ saturated or partially unsaturated aliphatic group, wherein one or more methylene units are optionally and independently replaced by an optionally substituted group selected from $C_1$-$C_6$ alkylene, $C_1$-$C_6$ alkenylene, —C≡C—, a $C_1$-$C_6$ heteroaliphatic moiety, —C(R')$_2$—, -Cy-, —O—, —S—, —S—S—, —N(R')—, —C(O)—, —C(S)—, —C(NR')—, C(O)N(R'), —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, and —C(O)O—.

986. The composition of any one of the preceding embodiments, wherein $R^{LD}$ is an optionally substituted, $C_{10}$-$C_{80}$ saturated or partially unsaturated aliphatic group, wherein one or more methylene units are optionally and independently replaced by —C(O)—.

987. The composition of any one of the preceding embodiments, wherein $R^{LD}$ is an optionally substituted, $C_{10}$-$C_{60}$ saturated or partially unsaturated aliphatic group, wherein one or more methylene units are optionally and independently replaced by —C(O)—.

988. The composition of any one of the preceding embodiments, wherein $R^{LD}$ is an optionally substituted, $C_{10}$-$C_{40}$ saturated or partially unsaturated aliphatic group, wherein one or more methylene units are optionally and independently replaced by —C(O)—.

989. The composition of any one of the preceding embodiments, wherein $R^{LD}$ comprises 10, 11, 12, 13, 14, 15, 16, 17, 18, 19, 20, 21, 22, 23, 24, 25, 26, 27, 28, 29, 30 or more carbon atoms.

990. The composition of any one of the preceding embodiments, wherein at least one $R^{LD}$ comprises or is a targeting component.

991. The composition of any one of the preceding embodiments, wherein at least one $R^{LD}$ is a targeting component.

992. The composition of any one of the preceding embodiments, wherein at least one $R^{LD}$ comprises a lipid moiety.

993. The composition of any one of the preceding embodiments, wherein at least one $R^{LD}$ is a lipid moiety.

994. The composition of any one of the preceding embodiments, wherein $R^{LD}$ is an optionally substituted, $C_{10}$-$C_{80}$ saturated or partially unsaturated aliphatic group.

995. The composition of any one of the preceding embodiments, wherein $R^{LD}$ is an optionally substituted, $C_{10}$-$C_{60}$ saturated or partially unsaturated aliphatic group.

996. The composition of any one of the preceding embodiments, wherein $R^{LD}$ is an optionally substituted, $C_{10}$-$C_{40}$ saturated or partially unsaturated aliphatic group.

997. The composition of any one of the preceding embodiments, wherein $R^{LD}$ is unsubstituted linear or branched $C_{10}$-$C_{80}$ aliphatic group.

998. The composition of any one of the preceding embodiments, wherein $R^{LD}$ is unsubstituted linear or branched $C_{10}$-$C_{60}$ aliphatic group.

999. The composition of any one of the preceding embodiments, wherein $R^{LD}$ is unsubstituted linear or branched $C_{10}$-$C_{40}$ aliphatic group.

1000. The composition of any one of embodiments 913-999, wherein $R^{LD}$ is palmityl.

1001. The composition of any one of the preceding embodiments 913-999, wherein $R^{LD}$ is

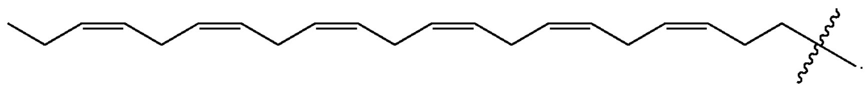 [SMILES: *CC/C=C\C/C=C\C/C=C\C/C=C\C/C=C\C/C=C\CC]

1002. The composition of any one of embodiments 913-999, wherein $R^{LD}$ is lauryl.

1003. The composition of any one of embodiments 913-999, wherein $R^{LD}$ is myristyl.

1004. The composition of any one of embodiments 913-999, wherein $R^{LD}$ is stearyl.

1005. The composition of any one of embodiments 913-999, wherein $R^{LD}$ is

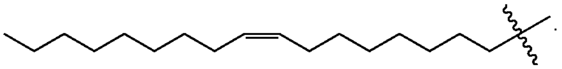 [SMILES: *CCCCCCC/C=C\CCCCCCCC]

1006. The composition of any one of embodiments 913-999, wherein $R^{LD}$ is

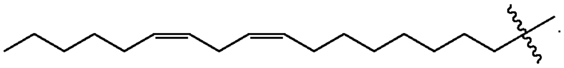 [SMILES: *CCCCCCC/C=C\C/C=C\CCCCC]

1007. The composition of any one of embodiments 913-999, wherein $R^{LD}$ is

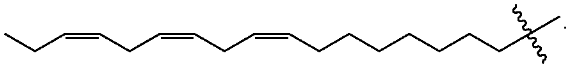

1008. The composition of any one of embodiments 913-999, wherein $R^{LD}$ is

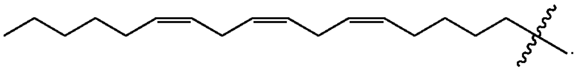

1009. The composition of any one of embodiments 913-999, wherein $R^{LD}$ is

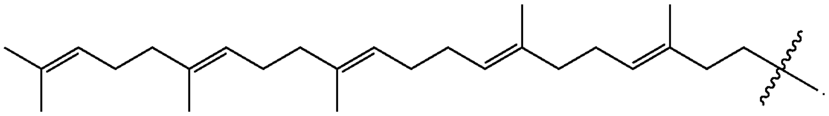 [SMILES: *CC/C(C)=C/CC/C(C)=C/CC/C=C(\C)CC/C=C(\C)CCC=C(C)C]

1010. The composition of any one of embodiments 913-999, wherein $R^{LD}$ is

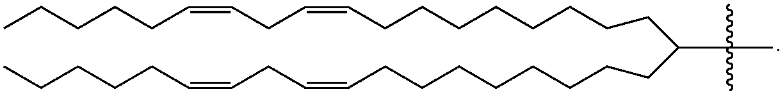

1011 The composition of any one of embodiments 913-993, wherein $R^{LD}$ is

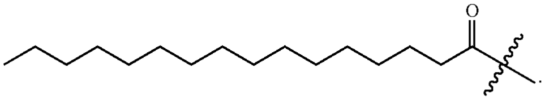 [SMILES: *C(=O)CCCCCCCCCCCCCCC]

1012. The composition of any one of embodiments 913-993 wherein $R^{LD}$ is

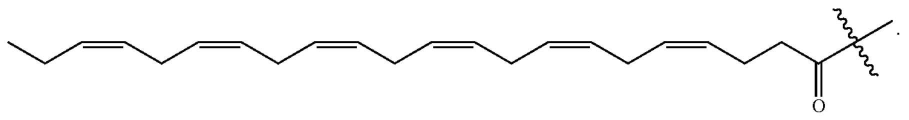 [SMILES: *C(=O)CC/C=C\C/C=C\C/C=C\C/C=C\C/C=C\C/C=C\CC]

1013. The composition of any one of embodiments 913-993, wherein $R^{LD}$ is

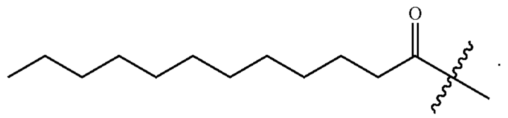 [SMILES: *C(=O)CCCCCCCCCCC]

1014. The composition of any one of embodiments 913-993, wherein $R^{LD}$ is

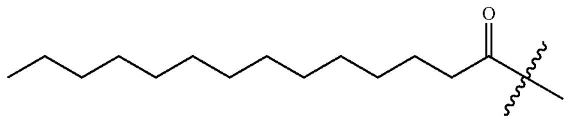 [SMILES: *C(=O)CCCCCCCCCCCCC]

1015. The composition of any one of embodiments 913-993, wherein $R^{LD}$ is

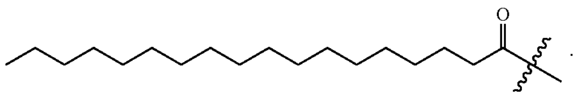 [SMILES: *C(=O)CCCCCCCCCCCCCCCCC]

1016. The composition of any one of embodiments 913-993, wherein $R^{LD}$ is

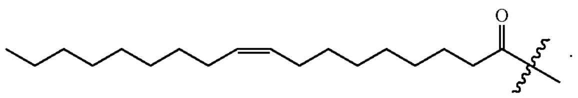 [SMILES: *C(=O)CCCCCCC/C=C\CCCCCCCC]

1017. The composition of any one of embodiments 913-993, wherein $R^{LD}$ is

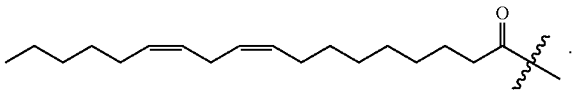 [SMILES: *C(=O)CCCCCCC/C=C\C/C=C\CCCCC]

1018. The composition of any one of embodiments 913-993, wherein $R^{LD}$ is

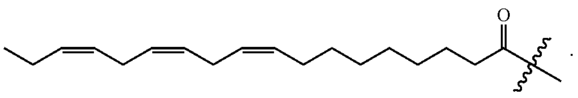 [SMILES: *C(=O)CCCCCCC/C=C\C/C=C\C/C=C\CC]

1019. The composition of any one of embodiments 913-993, wherein $R^{LD}$ is

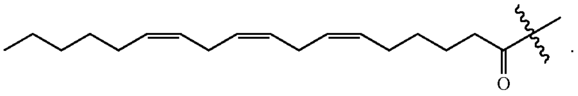 [SMILES: *C(=O)CCCC/C=C\C/C=C\C/C=C\CCCCC]

1020. The composition of any one of embodiments 913-993, wherein $R^{LD}$ is

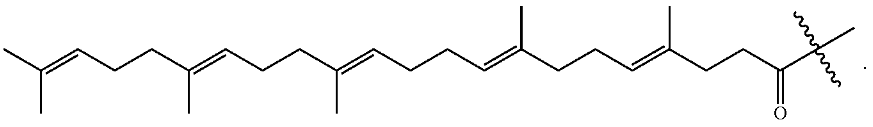 [SMILES: *C(=O)CC/C(C)=C/CC/C(C)=C/CC/C=C(\C)CC/C=C(\C)CCC=C(C)C]

1021. The composition of any one of embodiments 913-993, wherein $R^{LD}$ is
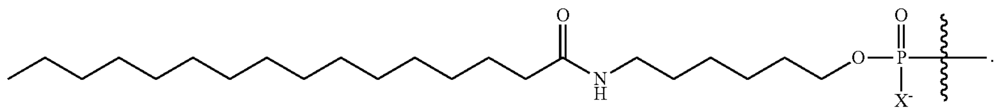
X = O or S
1022. The composition of any one of embodiments 913-993 wherein $R^{LD}$ is
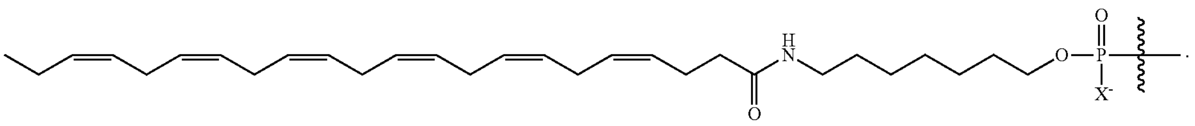
X = O or S
1023. The composition of any one of embodiments 913-993, wherein $R^{LD}$ is
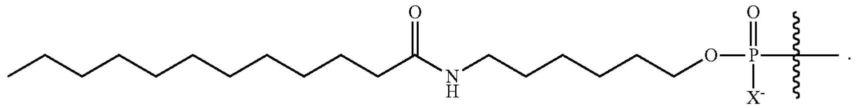
X = O or S
1024. The composition of any one of embodiments 913-993, wherein $R^{LD}$ is
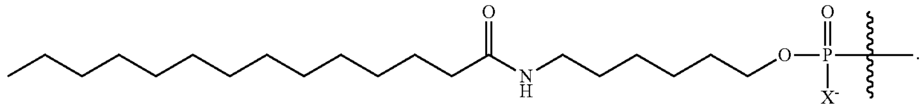
X = O or S
1025. The composition of any one of embodiments 913-993, wherein $R^{LD}$ is
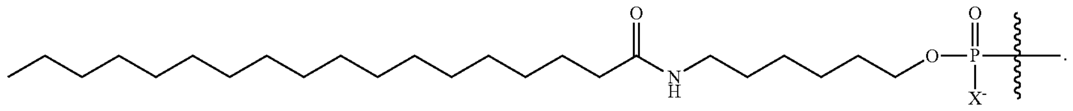
X = O or S 1026. The composition of any one of embodiments 913-993, wherein $R^{LD}$ is
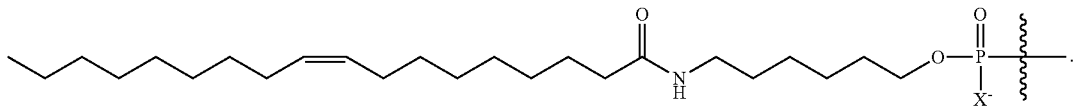
X = O or S
1027. The composition of any one of embodiments 913-993, wherein $R^{LD}$ is
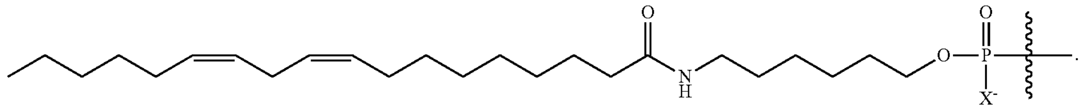
X = O or S
1028. The composition of any one of embodiments 913-993, wherein $R^{LD}$ is
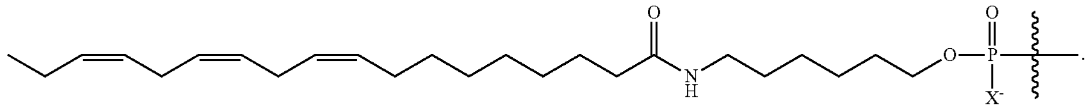
X = O or S
1029. The composition of any one of embodiments 913-993, wherein $R^{LD}$ is
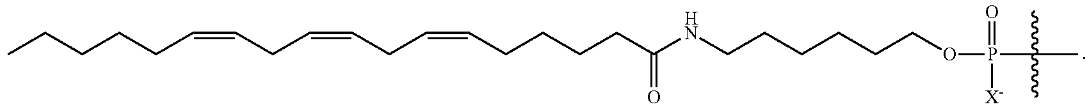
X = O or S
1030. The composition of any one of embodiments 913-993, wherein $R^{LD}$ is
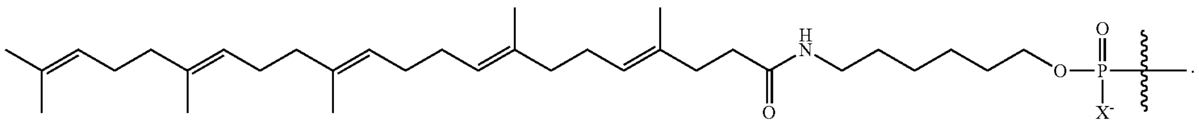
X = O or S 1031. The composition of any one of embodiments 913-993, wherein $R^{LD}$ is

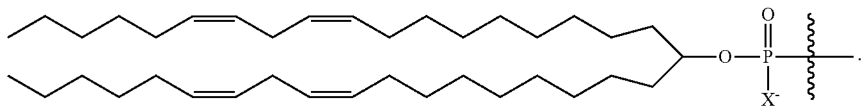

X = O or S

1032. The composition of any one of embodiments 913-993, wherein $R^{LD}$ is

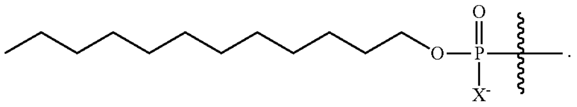

X = O or S

1033. The composition of any one of embodiments 913-993, wherein $R^{LD}$ is

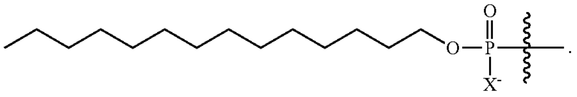

X = O or S

1034. The composition of any one of embodiments 913-993, wherein $R^{LD}$ is

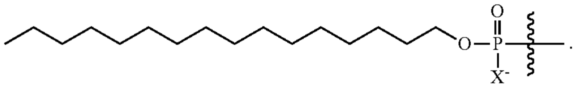

X = O or S

1035. The composition of any one of embodiments 913-993, wherein $R^{LD}$ is

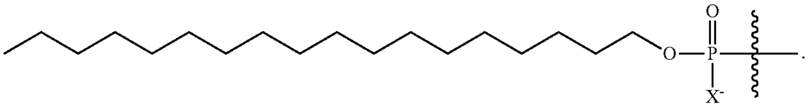

X = O or S

1036. The composition of any one of embodiments 913-993, wherein $-[-L^{LD}-(R^{LD})_a]_b$ is

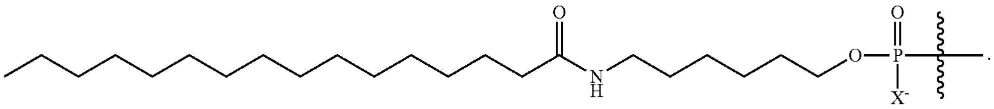

X = O or S

1037. The composition of any one of embodiments 913-993, wherein $-[-L^{LD}-(R^{LD})_a]_b$ is

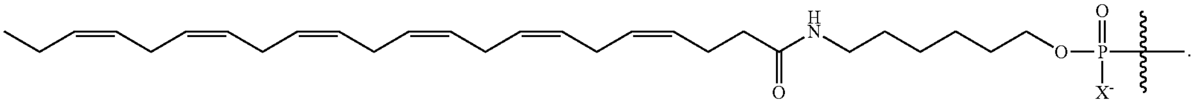

X = O or S

1038. The composition of any one of embodiments 913-993, wherein $-[-L^{LD}-R^{LD})_a]_b$ is

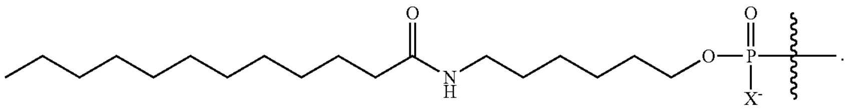

X = O or S

1039. The composition of any one of embodiments 913-993, wherein $-[-L^{LD}-(R^{LD})_a]_b$ is

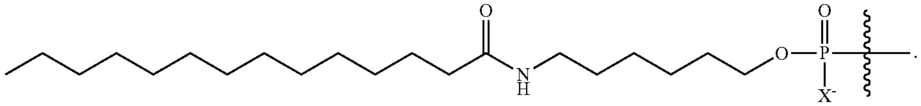

X = O or S

1040. The composition of any one of embodiments 913-993, wherein $-[-L^{LD}-(R^{LD})_a]_b$ is

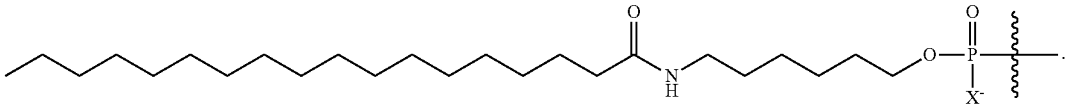

X = O or S

1041. The composition of any one of embodiments 913-993, wherein $-[-L^{LD}-(R^{LD})_a]_b$ is

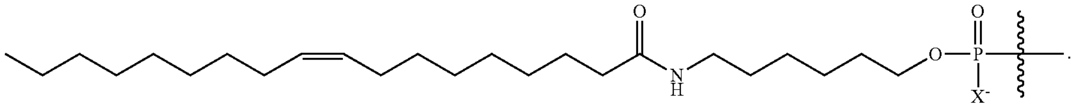

X = O or S

1042. The composition of any one of embodiments 913-993, wherein $-[-L^{LD}-(R^{LD})_a]_b$ is

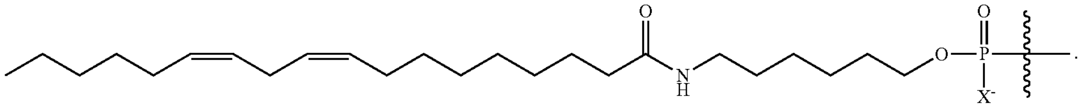

X = O or S

1043. The composition of any one of embodiments 913-993, wherein $-[-L^{LD}-(R^{LD})_a]_b$ is

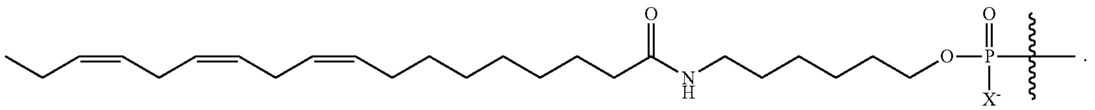

X = O or S

1044. The composition of any one of embodiments 913-993, wherein $-[-L^{LD}-(R^{LD})_a]_b$ is

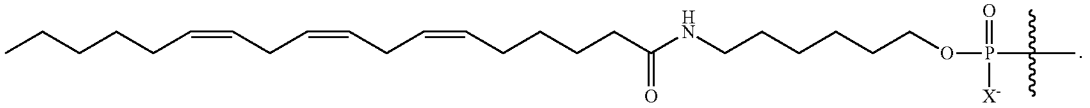

X = O or S

1045. The composition of any one of embodiments 913-993, wherein $-[-L^{LD}-(R^{LD})_a]_b$ is

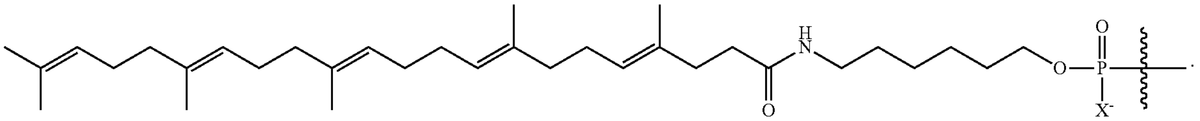

X = O or S

1046. The composition of any one of embodiments 913-993, wherein $-[-L^{LD}-(R^{LD})_a]_b$ is

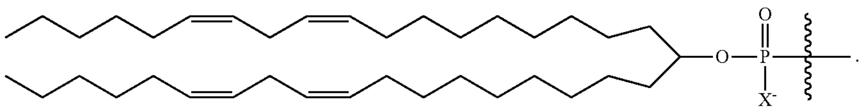

X = O or S

1047. The composition of any one of embodiments 913-993, wherein $-[-L^{LD}-(R^{LD})_a]_b$ is

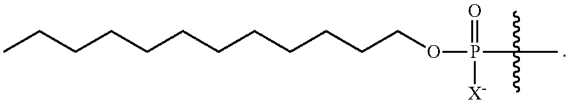

X = O or S

1048. The composition of any one of embodiments 913-993, wherein $-[-L^{LD}-(R^{LD})_a]_b$ is

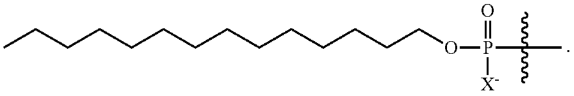

X = O or S

1049. The composition of any one of embodiments 913-993, wherein $-[-L^{LD}-(R^{LD})_a]_b$ is
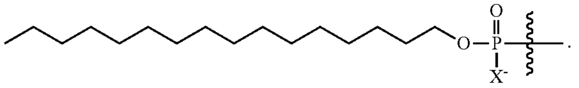
X = O or S
1050. The composition of any one of embodiments 913-993, wherein $-[-L^{LD}-(R^{LD})_a]_b$ is
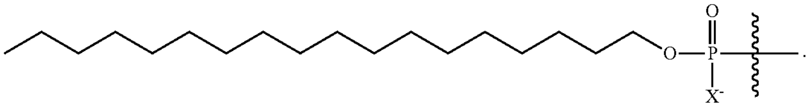
X = O or S
1051. The composition of any one of embodiments 913-991, wherein $R^{LD}$ is
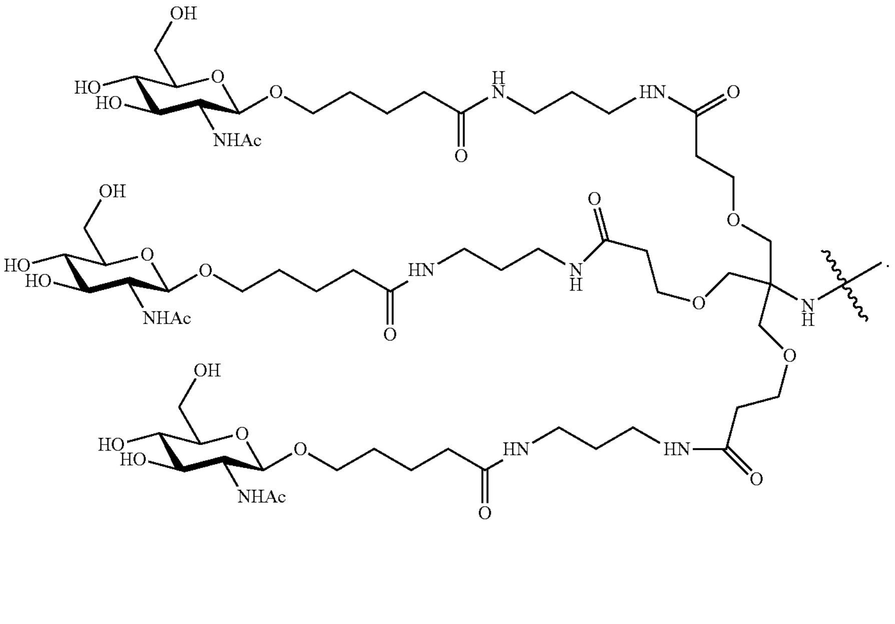

1052. The composition of any one of embodiments 913-991, wherein $R^{LD}$ is
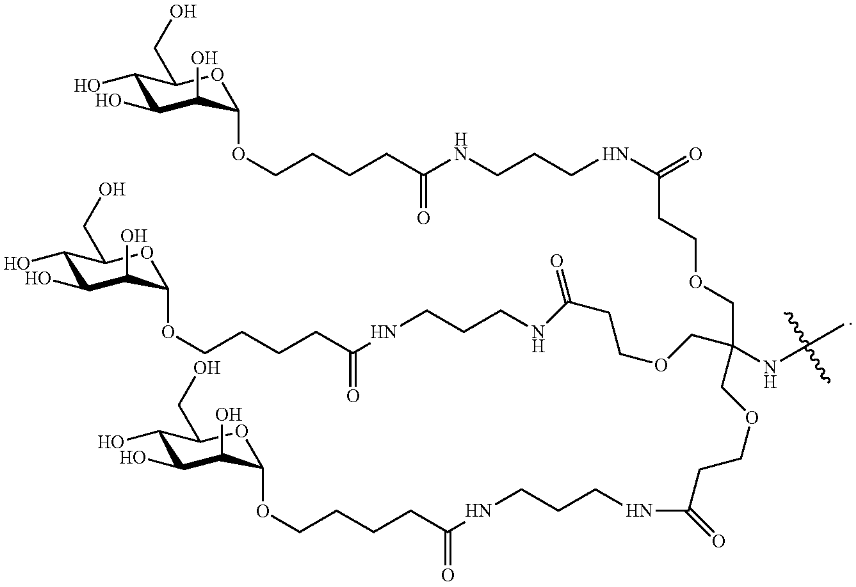
1053. The composition of any one of embodiments 913-991, wherein $R^{LD}$ is
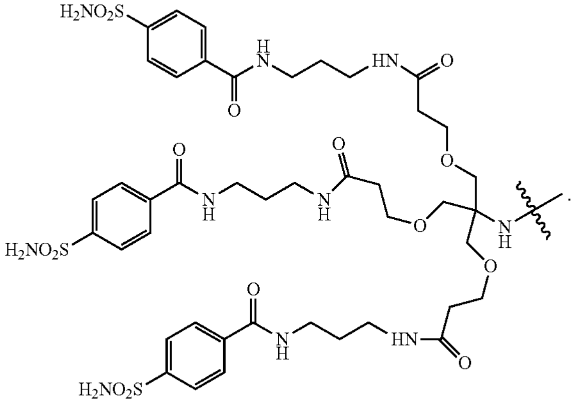 [SMILES: *NC(COCCC(=O)NCCCNC(=O)c1ccc(S(N)(=O)=O)cc1)(COCCC(=O)NCCCNC(=O)c1ccc(S(N)(=O)=O)cc1)COCCC(=O)NCCCNC(=O)c1ccc(S(N)(=O)=O)cc1]

1054. The composition of any one of embodiments 913-991, wherein $R^{LD}$ is
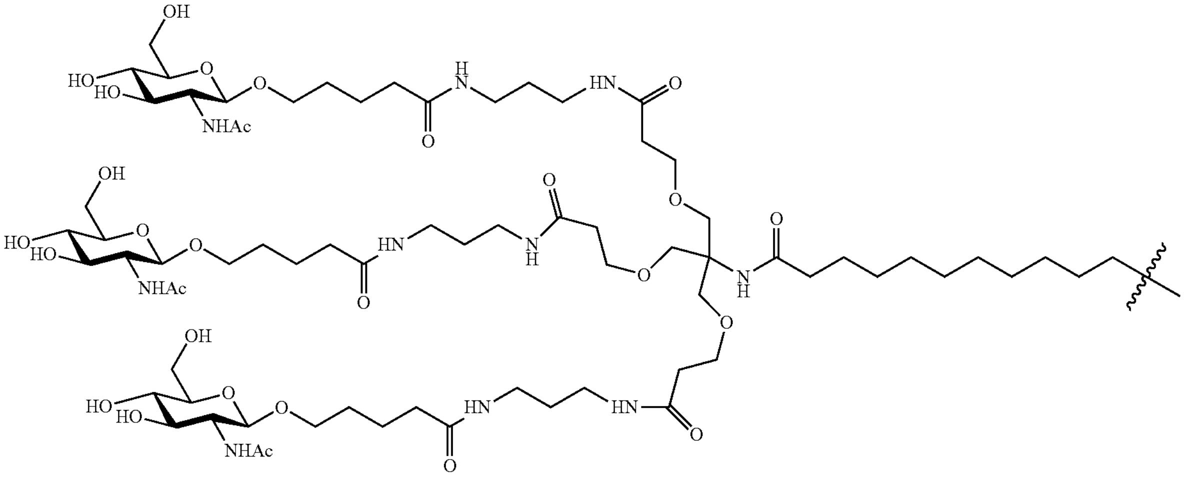
.
1055. The composition of any one of embodiments 913-991, wherein $R^{LD}$ is
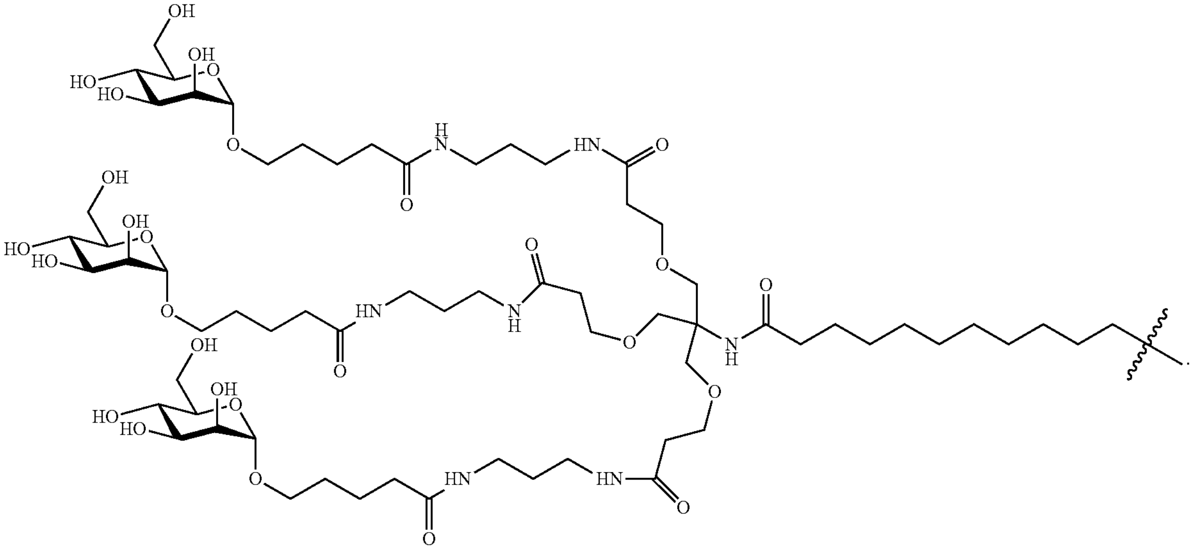
.

1056. The composition of any one of embodiments 913-991, wherein $R^{LD}$ is
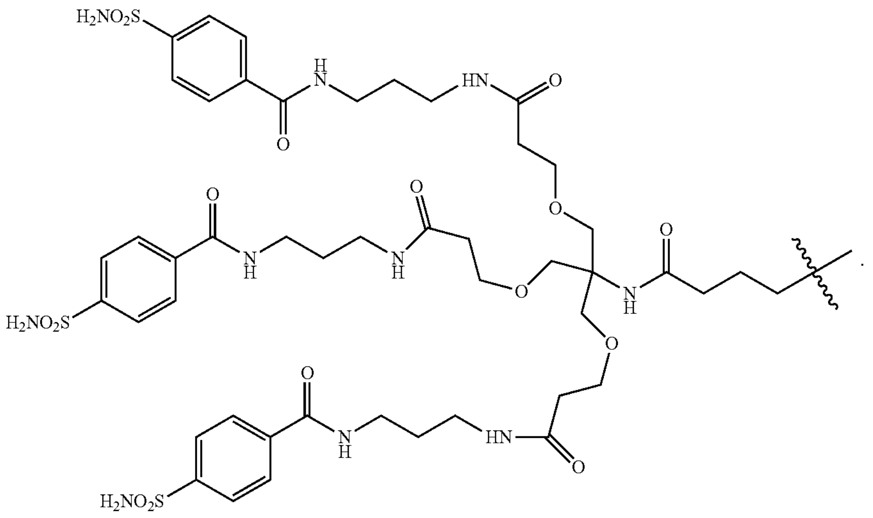 [SMILES: *CCCC(=O)NC(COCCC(=O)NCCCNC(=O)c1ccc(S(N)(=O)=O)cc1)(COCCC(=O)NCCCNC(=O)c1ccc(S(N)(=O)=O)cc1)COCCC(=O)NCCCNC(=O)c1ccc(S(N)(=O)=O)cc1]
1057. The composition of any one of embodiments 913-985 and 990-991, wherein $R^{LD}$ is
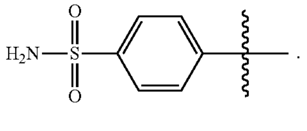 [SMILES: *c1ccc(S(N)(=O)=O)cc1]
1058. The composition of any one of embodiments 913-991, wherein $R^{LD}$ is
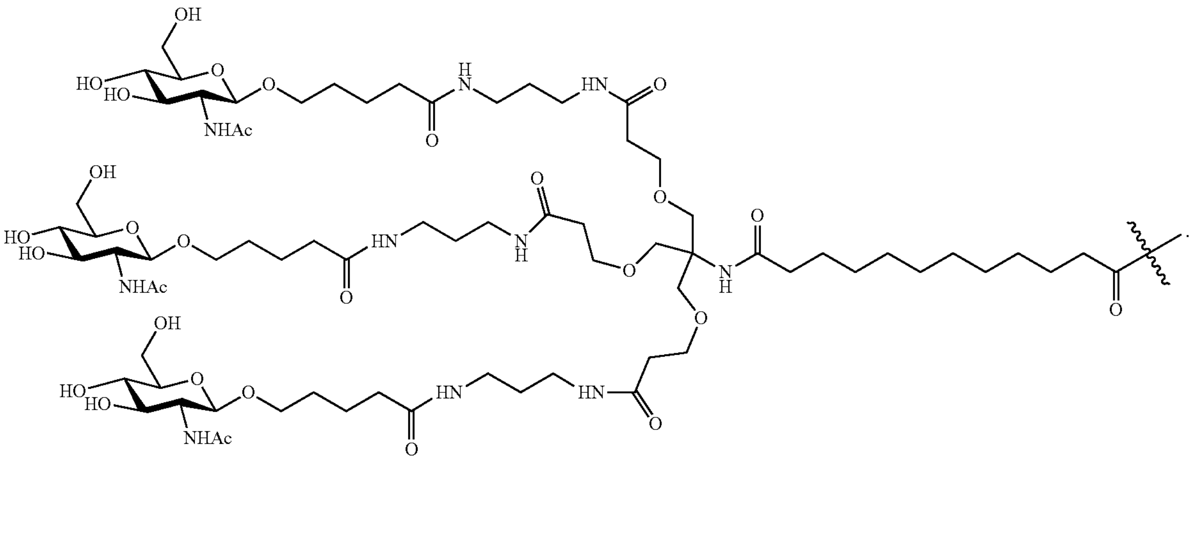

1059. The composition of any one of embodiments 913-991, wherein $R^{LD}$ is
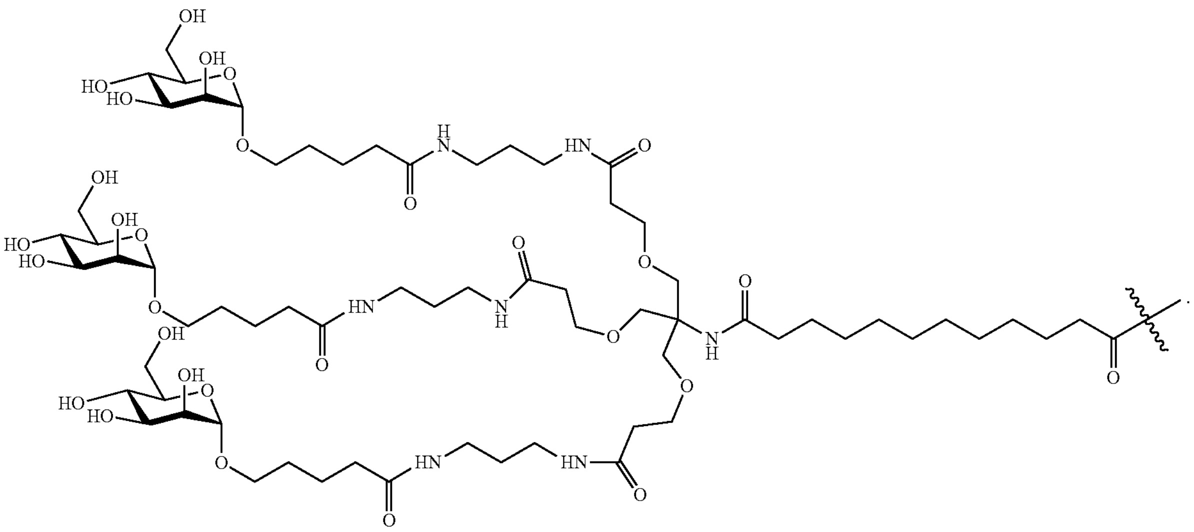
1060. The composition of any one of embodiments 913-985 and 990-991, wherein $R^{LD}$ is
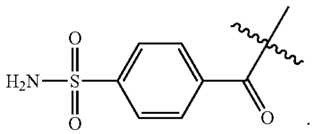 [SMILES: *C(=O)c1ccc(S(N)(=O)=O)cc1]
1061. The composition of any one of embodiments 913-991, wherein $R^{LD}$ is $H_2NO_2S$
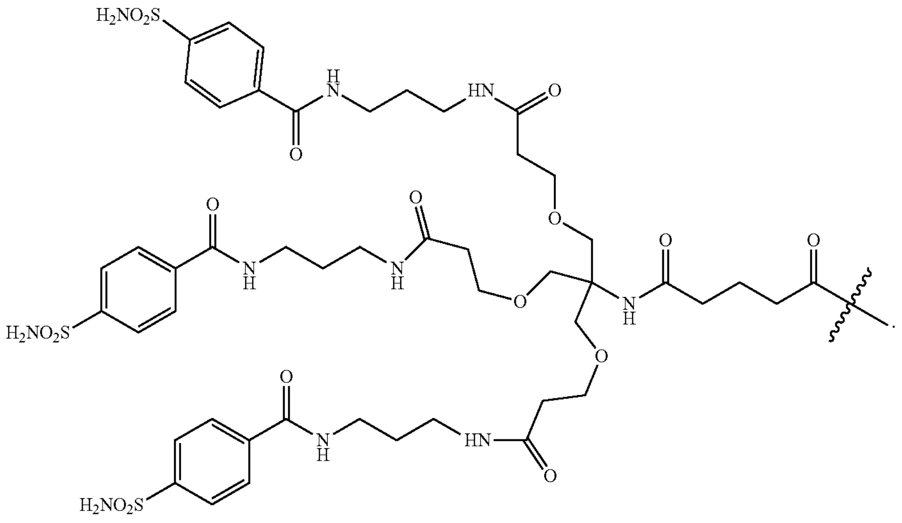 [SMILES: *C(=O)CCCC(=O)NC(COCCC(=O)NCCCNC(=O)c1ccc(S(N)(=O)=O)cc1)(COCCC(=O)NCCCNC(=O)c1ccc(S(N)(=O)=O)cc1)COCCC(=O)NCCCNC(=O)c1ccc(S(N)(=O)=O)cc1]

1062. The composition of any one of embodiments 913-991, wherein $R^{LD}$ is
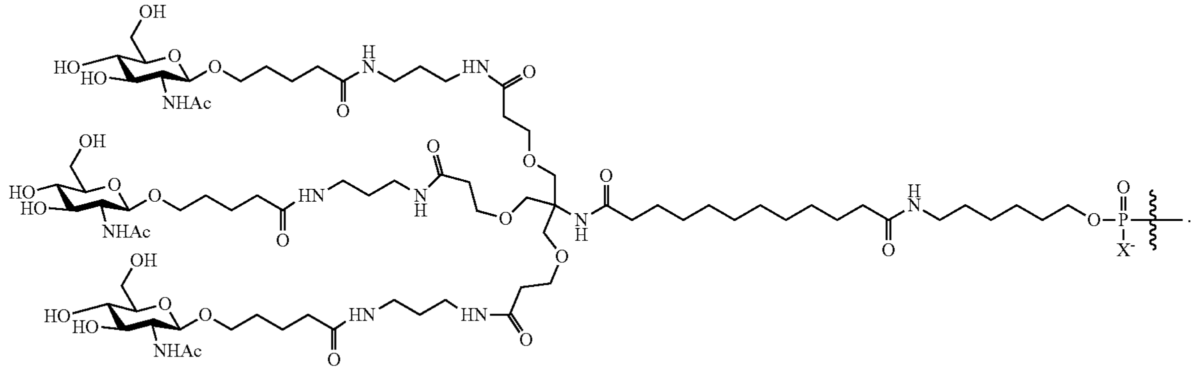
X = O or S
1063. The composition of any one of embodiments 913-991, wherein $R^{LD}$ is
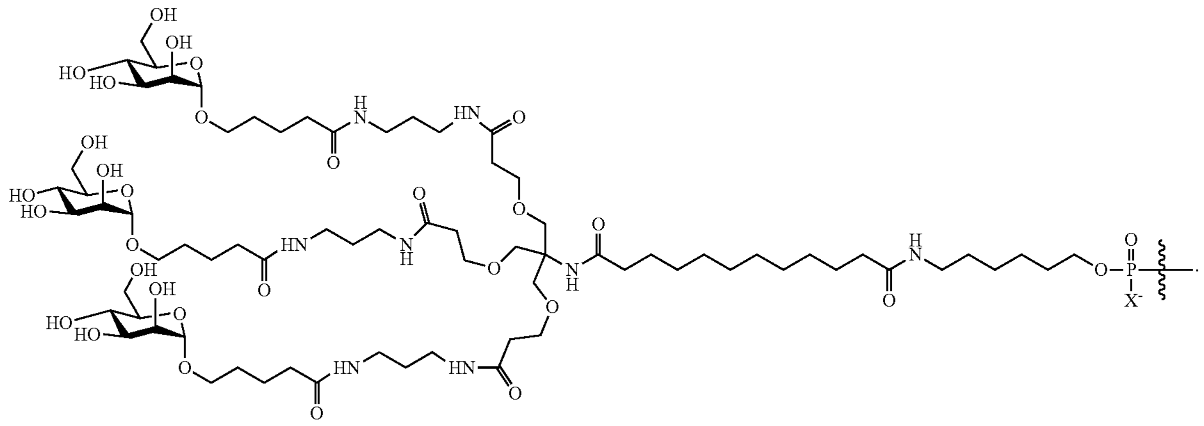
X = O or S 1064. The composition of any one of embodiments 913-991, wherein $R^L$ is
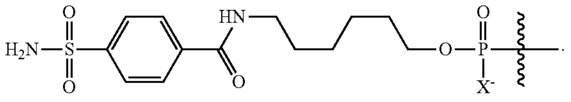
X = O or S
1065. The composition of any one of embodiments 913-991, wherein $R^L$ is
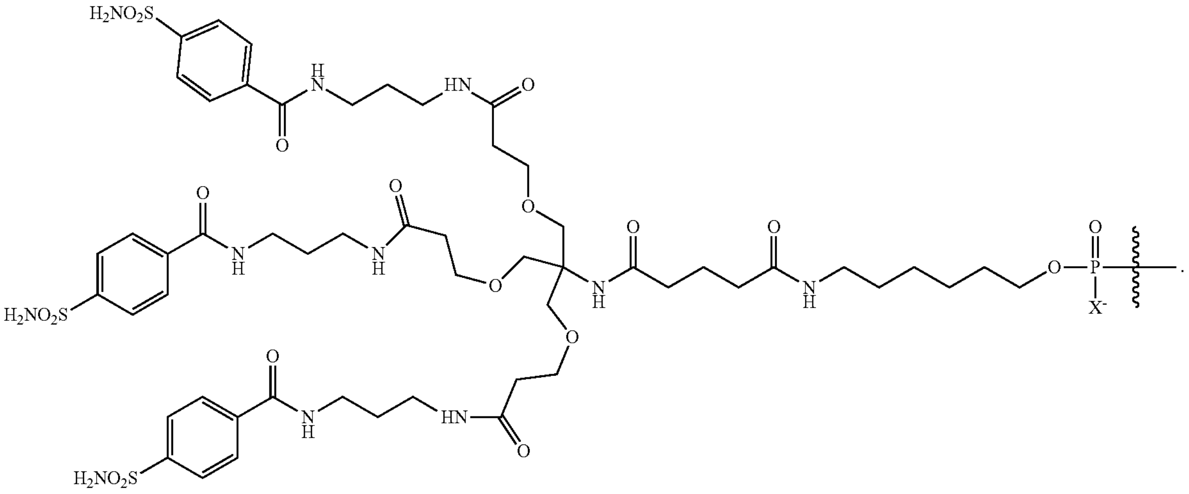
X = O or S
1066. The composition of any one of embodiments 913-991, wherein $-[-L^{LD}-(R^{LD})_a]_b$ is
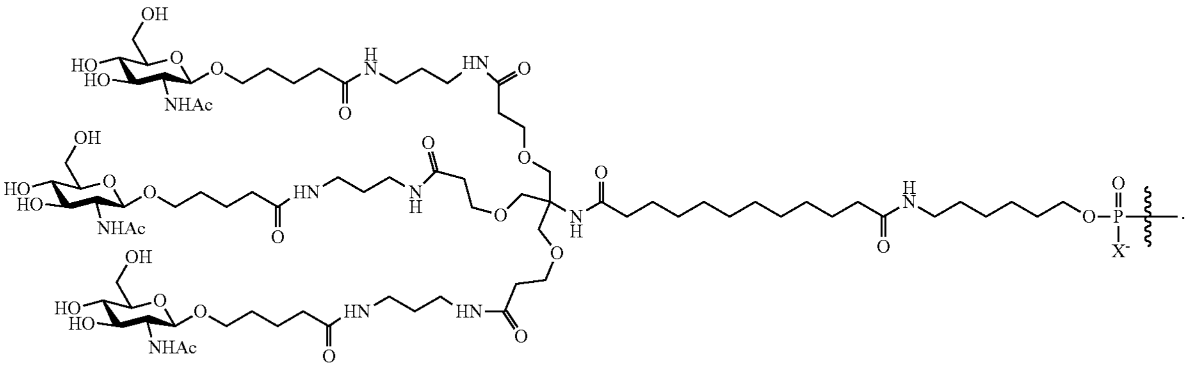
X = O or S 1067. The composition of any one of embodiments 913-991, wherein -[~~$L^{LD}$-$(R^{LD})_a]_b$ is
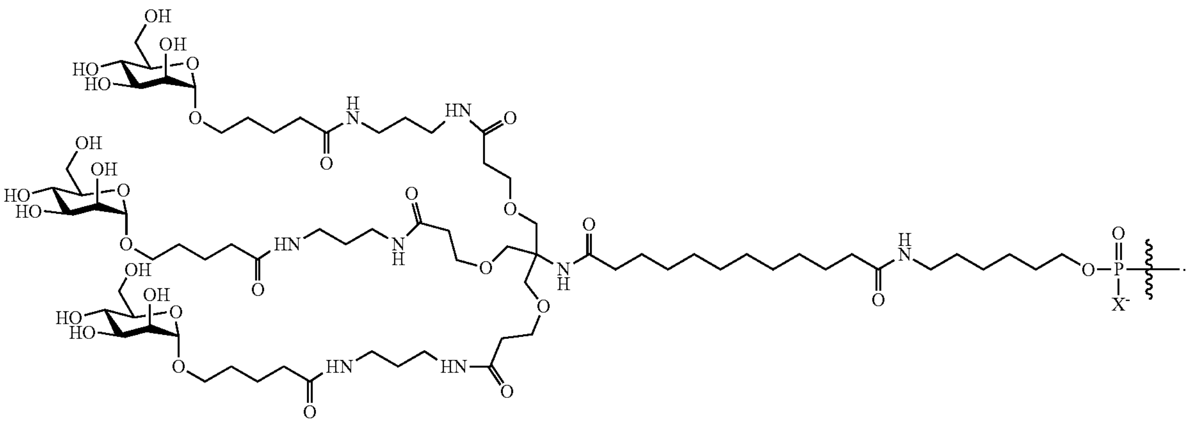
X = O or S
1068. The composition of any one of embodiments 913-991, wherein -[~~$L^{LD}$-$(R^{LD})_a]_b$ is
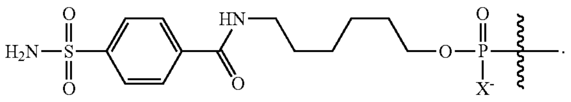
X = O or S
1069. The composition of any one of embodiments 913-991, wherein -[-$L^{LD}$-$(R^{LD})_a]_b$ is
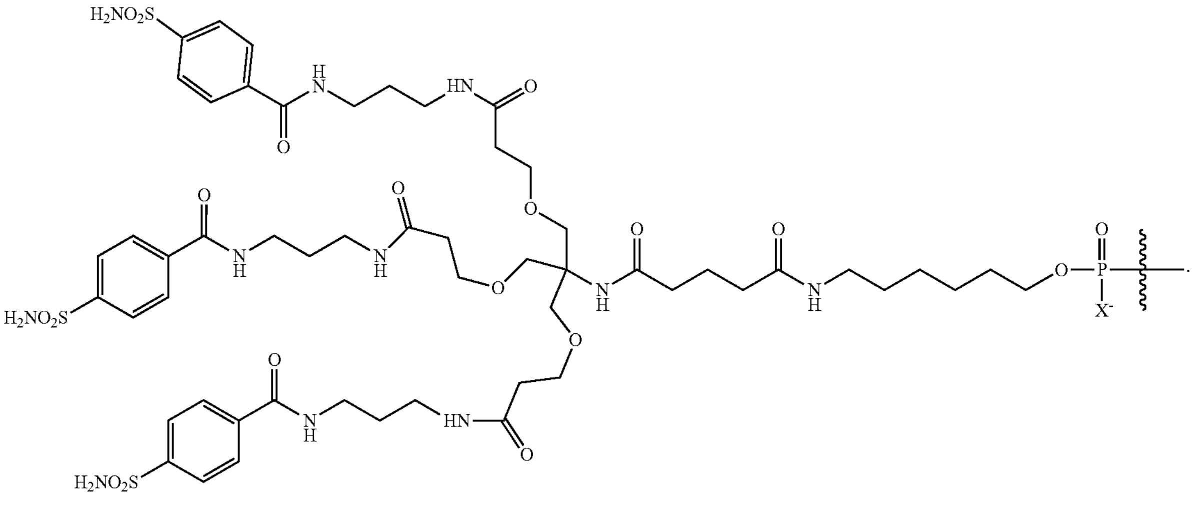
X = O or S 1070. The composition of any one of embodiments 1021-1050 and 1062-1069, wherein X is O.

1071. The composition of any one of embodiments 1021-1050 and 1062-1069, wherein X is S.

1072. The composition of embodiment 1070, wherein —O—P(O)($X^-$)— connects to 5'-O— of $A^c$ to form a phosphate linkage.

1073. The composition of embodiment 1070, wherein —O—P(O)($X^-$)— connects to 3'-O— of $A^c$ to form a phosphate linkage.

1074. The composition of embodiment 1071, wherein —O—P(O)($X^-$)— connects to 5'-O— of $A^c$ to form a phosphorothioate linkage.

1075. The composition of embodiment 1071, wherein —O—P(O)($X^-$)— connects to 3'-O— of $A^c$ to form a phosphorothioate linkage.

1076. The composition of embodiment 1074 or 1075, wherein the phosphorothioate linkage is chirally controlled.

1077. The composition of embodiment 1074 or 1075, wherein the phosphorothioate linkage is chirally controlled and is Sp.

1078. The composition of embodiment 1074 or 1075, wherein the phosphorothioate linkage is chirally controlled and is Rp.

1079. The composition of any one of the preceding embodiments, wherein at least 0.5%, 1%, 2%, 3%, 4%, 5%, 6%, 7%, 8%, 9%, 10%, 20%, 30%, 40%, 50%, 60%, 70%, 75%, 80%, 81%, 82%, 83%, 84%, 85%, 86%, 87%, 88%, 89%, 90%, 91%, 92%, 93%, 94%, 95%, 96%, 97%, 97% or 99% of the oligonucleotides that have the base sequence of the particular oligonucleotide type, defined by 1) base sequence; 2) pattern of backbone linkages; 3) pattern of backbone chiral centers; and 4) pattern of backbone phosphorus modifications, are oligonucleotides of the particular oligonucleotide type.

1080. The composition of any one of the preceding embodiments, wherein at least 10% of the oligonucleotides that have the base sequence of the particular oligonucleotide type, defined by 1) base sequence; 2) pattern of backbone linkages; 3) pattern of backbone chiral centers; and 4) pattern of backbone phosphorus modifications, are oligonucleotides of the particular oligonucleotide type.

1081. The composition of any one of the preceding embodiments, wherein at least 0.5%, 1%, 2%, 3%, 4%, 5%, 6%, 7%, 8%, 9%, 10%, 20%, 30%, 40%, 50%, 60%, 70%, 75%, 80%, 81%, 82%, 83%, 84%, 85%, 86%, 87%, 88%, 89%, 90%, 91%, 92%, 93%, 94%, 95%, 96%, 97%, 97% or 99% of the oligonucleotides that have the base sequence, pattern of backbone linkages, and pattern of backbone phosphorus modifications of the particular oligonucleotide type, defined by 1) base sequence; 2) pattern of backbone linkages; 3) pattern of backbone chiral centers; and 4) pattern of backbone phosphorus modifications, are oligonucleotides of the particular oligonucleotide type.

1082. The composition of any one of the preceding embodiments, wherein at least 10% of the oligonucleotides that have the base sequence, pattern of backbone linkages, and pattern of backbone phosphorus modifications of the particular oligonucleotide type, defined by 1) base sequence; 2) pattern of backbone linkages; 3) pattern of backbone chiral centers; and 4) pattern of backbone phosphorus modifications, are oligonucleotides of the particular oligonucleotide type.

1083. The composition of any one of the preceding embodiments, wherein at least 0.5%, 1%, 2%, 3%, 4%, 5%, 6%, 7%, 8%, 9%, 10%, 20%, 30%, 40%, 50%, 60%, 70%, 75%, 80%, 81%, 82%, 83%, 84%, 85%, 86%, 87%, 88%, 89%, 90%, 91%, 92%, 93%, 94%, 95%, 96%, 97%, 97% or 99% of the oligonucleotides that have the base sequence, pattern of backbone linkages, and pattern of backbone phosphorus modifications of the particular oligonucleotide type, defined by 1) base sequence; 2) pattern of backbone linkages; 3) pattern of backbone chiral centers; and 4) pattern of backbone phosphorus modifications, are oligonucleotides of the particular oligonucleotide type.

1084. The composition of any one of the preceding embodiments, wherein at least 10% of the oligonucleotides that have the base sequence, pattern of backbone linkages, and pattern of backbone phosphorus modifications of the particular oligonucleotide type, defined by 1) base sequence; 2) pattern of backbone linkages; 3) pattern of backbone chiral centers; and 4) pattern of backbone phosphorus modifications, are oligonucleotides of the particular oligonucleotide type.

1085. The composition of any one of the preceding embodiments, wherein the composition is a pharmaceutical composition comprising one or more pharmaceutically acceptable salts of the oligonucleotides.

1086. The composition of any one of the preceding embodiments, wherein the composition is a pharmaceutical composition comprising one or more pharmaceutically acceptable sodium salts of the oligonucleotides.

1087. The composition of any one of the proceeding embodiments, wherein the composition further comprises one or more other therapeutic agents.

1088. The composition of any one of the proceeding embodiments, wherein the composition further comprises one or more utrophin modulators.

1089. The composition of any one of the proceeding embodiments, wherein the composition further comprises ezutromid.

1090. A method for altering splicing of a target transcript, comprising administering a composition of any one of the preceding embodiments, wherein the splicing of the target transcript is altered relative to reference conditions selected from the group consisting of absence of the composition, presence of a reference composition, and combinations thereof.

1091. A method of generating a set of spliced products from a target transcript, the method comprising steps of:

contacting a splicing system containing the target transcript with an oligonucleotide composition of one of the previous embodiments in an amount, for a time, and under conditions sufficient for a set of spliced products to be generated that is different from a set generated under reference conditions selected from the group consisting of absence of the composition, presence of a reference composition, and combinations thereof.

1092. A method for treating a disease, comprising administering to a subject a composition of any one of the preceding embodiments.

1093. The method of embodiment 1092, wherein the disease is selected from Table ES3.

1094. The method of any one of the preceding embodiments, wherein the disease is Duchenne muscular dystrophy.

1095. The method of any one of the preceding embodiments, wherein the disease is Duchenne muscular dystrophy, and one or more exons of dystrophin are skipped.

1096. The method of embodiment 1092, wherein the disease is Duchenne muscular dystrophy, one or more exons of MSTN are skipped.

1097. The method of embodiment 1095-1096, wherein the disease is Duchenne muscular dystrophy, and one or more of exon 51, 53, 45, 50, 44, 52, 55 and 8 of dystrophin are skipped.

1098. The method of embodiment 1095-1096, wherein the disease is Duchenne muscular dystrophy, and exon 51 of dystrophin is skipped.

1099. The method of embodiment 1095-1096, wherein the disease is Duchenne muscular dystrophy, and exon 2 of MSTN is skipped.

1100. The method of any one of the preceding embodiments, comprising utrophin modulation.

1101. The method of any one of the preceding embodiments, comprising providing and/or administering a utrophin modulator.

1102. The method of embodiment 1101, wherein the utrophin modulator is ezutromid.

1103. In a method of treating a disease by administering a composition comprising a first plurality of oligonucleotides sharing a common base sequence, which nucleotide sequence is complementary to a target sequence in the target transcript, the improvement that comprises using as the oligonucleotide composition a stereocontrolled oligonucleotide composition characterized in that, when it is contacted with the transcript in a transcript splicing system, splicing of the transcript is altered relative to that observed under reference conditions selected from the group consisting of absence of the composition, presence of a reference composition, and combinations thereof.

1104. In a method of altering transcript splicing of a particular target transcript by contacting the transcript with an oligonucleotide composition of any one of the preceding embodiments comprising a first plurality of oligonucleotides sharing a common base sequence, which nucleotide sequence is complementary to a target sequence in the target transcript, the improvement that comprises using as the oligonucleotide composition a stereocontrolled oligonucleotide composition characterized in that, when it is contacted with the transcript in a transcript splicing system, splicing of the transcript is altered relative to that observed under reference conditions selected from the group consisting of absence of the composition, presence of a reference composition, and combinations thereof.

1105. The method of embodiment 1103 or 1104, wherein the common base sequence comprises a sequence selected from Table ES1.

1106. The method of embodiment 1103 or 1104, wherein the common base sequence is a sequence selected from Table ES1.

1107. The method of embodiment 1103 or 1104, wherein the common base sequence is a sequence selected from Tables 1-4.

1108. The method of embodiment 1103 or 1104, wherein the common base sequence is UCAAGGAAGAUGGCAUUUCU (SEQ ID NO: 54).

1109. The method of embodiment 1103 or 1104, wherein the common base sequence is CTCCAACATCAAGGAAGATGGCATTTCTAG (SEQ ID NO: 870).

1110. The method of any one of the preceding embodiments, wherein the improvement comprises administering a stereocontrolled oligonucleotide composition at a dose and/or frequency lower than that of an otherwise comparable stereorandom reference oligonucleotide composition with comparable effect in altering the splicing of the target transcript.

1111. The method of any one of the preceding embodiments, wherein the composition comprising a first plurality of oligonucleotides displays reduced side effects relative to comparable dosing with otherwise comparable stereorandom reference oligonucleotide composition.

1112. The method of any one of the preceding embodiments, wherein the transcript is a pre-mRNA, and a splicing product is an mRNA.

1113. The method of any one of the preceding embodiments, wherein relative levels of one or more splicing products are changed.

1114. The method of any one of the preceding embodiments, wherein levels of one or more splicing products are increased.

1115. The method of any one of the preceding embodiments, wherein levels of one or more splicing products are decreased.

1116. The method of any one of the preceding embodiments, wherein level and/or activity of a polypeptide encoded by the transcript is reduced relative to that observed under reference conditions.

1117. The method of any one of the preceding embodiments, wherein one or more exons are skipped so that level of a truncated form of a polypeptide encoded by the transcript is increased.

1118. The method of any one of the preceding embodiments, wherein one or more exons are skipped so that level of a truncated form of a polypeptide encoded by the transcript is decreased.

1119. The method of any one of the preceding embodiments, wherein one or more exons are skipped so that level of a lengthened form of a polypeptide encoded by the transcript is increased.

1120. The method of any one of the preceding embodiments, wherein one or more exons are skipped so that level of a lengthened form of a polypeptide encoded by the transcript is decreased.

1121. The method of any one of the preceding embodiments, wherein a skipped exon comprises one or more premature stop codon.

1122. The method of any one of the preceding embodiments, wherein a skipped exon comprises a frameshift mutation.

1123. The method of any one of the preceding embodiments, wherein a skipped exon comprises no mutations.

1124. The method of any one of the preceding embodiments, wherein the altered splicing comprises increasing levels of mRNA having less expanded repeat.

1125. The method of embodiment 1114, wherein the target transcript is a transcript selected from Table ES2, and/or the disease is a disease selected from Table ES2.

1126. The method of embodiment 1114, wherein the target transcript is a transcript of dystrophin.

1127. A method of identifying and/or characterizing an oligonucleotide composition, the method comprising steps of:

providing at least one composition of any one of the preceding embodiments;

assessing splicing pattern of a transcript relative to a reference composition.

1128. A method for manufacturing an oligonucleotide composition directed to a selected target sequence, the method comprising steps of:

manufacturing an oligonucleotide composition comprising a first plurality of oligonucleotides of any one of the preceding embodiments, each of which has a base sequence complementary to the target sequence.

1129. A method for reducing hTLR9 agonist activities, comprising conjugating the oligonucleotides to one or more lipids.

1130. A method for increasing hTLR9 antagonist activities, comprising conjugating the oligonucleotides to one or more lipids.

1131. The method of embodiment 1129 or 1130, wherein the conjugation provides an oligonucleotide described in, or a composition of, any one of embodiments 913-1089.

1132. The composition or method of any one of the preceding embodiments, wherein the plurality of oligonucleotides share a common pattern of sugar modification, which comprises 3, 4, 5, 6, 7, 8, 9 or more 2'-F.

1133. The composition or method of any one of the preceding embodiments, wherein the plurality of oligonucleotides share a common pattern of sugar modification, which comprises 3 or more 2'-F.

1134. The composition or method of any one of the preceding embodiments, wherein the plurality of oligonucleotides share a common pattern of sugar modification, which comprises 3, 4, 5, 6, 7, 8, 9 or more consecutive 2'-F.

1135. The composition or method of any one of the preceding embodiments, wherein the plurality of oligonucleotides share a common pattern of sugar modification, which comprises 3 or more consecutive 2'-F.

1136. The composition or method of any one of the preceding embodiments, wherein the plurality of oligonucleotides share a common pattern of sugar modification, which comprises 3, 4, 5, 6, 7, 8, 9 or more consecutive 2'-F within the 10 nucleotide at the 5'-end.

1137. The composition or method of any one of the preceding embodiments, wherein the plurality of oligonucleotides share a common pattern of sugar modification, which comprises 3 or more consecutive 2'-F within the 10 nucleotide at the 5'-end.

1138. The composition or method of any one of the preceding embodiments, wherein the plurality of oligonucleotides share a common pattern of sugar modification, which comprises 3, 4, 5, 6, 7, 8, 9 or more 2'-F within the 10 nucleotide at the 5'-end.

1139. The composition or method of any one of the preceding embodiments, wherein the plurality of oligonucleotides share a common pattern of sugar modification, which comprises 3 or more 2'-F within the 10 nucleotide at the 5'-end.

1140. The composition or method of any one of the preceding embodiments, wherein the plurality of oligonucleotides share a common pattern of sugar modification, which comprises 3, 4, 5, 6, 7, 8, 9 or more consecutive 2'-F at the 5'-end.

1141. The composition or method of any one of the preceding embodiments, wherein the plurality of oligonucleotides share a common pattern of sugar modification, which comprises 3 or more consecutive 2'-F at the 5'-end.

1142. The composition or method of any one of the preceding embodiments, wherein the plurality of oligonucleotides share a common pattern of sugar modification, which comprises 3, 4, 5, 6, 7, 8, 9 or more consecutive 2'-F within the 10 nucleotide at the 3'-end.

1143. The composition or method of any one of the preceding embodiments, wherein the plurality of oligonucleotides share a common pattern of sugar modification, which comprises 3 or more consecutive 2'-F within the 10 nucleotide at the 3'-end.

1144. The composition or method of any one of the preceding embodiments, wherein the plurality of oligonucleotides share a common pattern of sugar modification, which comprises 3, 4, 5, 6, 7, 8, 9 or more 2'-F within the 10 nucleotide at the 3'-end.

1145. The composition or method of any one of the preceding embodiments, wherein the plurality of oligonucleotides share a common pattern of sugar modification, which comprises 3 or more 2'-F within the 10 nucleotide at the 3'-end.

1146. The composition or method of any one of the preceding embodiments, wherein the plurality of oligonucleotides share a common pattern of sugar modification, which comprises 3, 4, 5, 6, 7, 8, 9 or more consecutive 2'-F at the 3'-end.

1147. The composition or method of any one of the preceding embodiments, wherein the plurality of oligonucleotides share a common pattern of sugar modification, which comprises 3 or more consecutive 2'-F at the 3'-end.

1148. The composition or method of any one of the preceding embodiments, wherein the plurality of oligonucleotides share a common pattern of sugar modification, which comprises 5 or more consecutive 2'-F within the 10 nucleotide at the 5'-end.

1149. The composition or method of any one of the preceding embodiments, wherein the plurality of oligonucleotides share a common pattern of sugar modification, which comprises 5 or more 2'-F within the 10 nucleotide at the 3'-end.

1150. The composition or method of any one of the preceding embodiments, wherein the plurality of oligonucleotides share a common pattern of sugar modification, which comprises 6 or more consecutive 2'-F within the 10 nucleotide at the 5'-end.

1151. The composition or method of any one of the preceding embodiments, wherein the plurality of oligonucleotides share a common pattern of sugar modification, which comprises 6 or more 2'-F within the 10 nucleotide at the 3'-end.

1152. The composition or method of any one of the preceding embodiments, wherein the plurality of oligonucleotides share a common pattern of sugar modification, which comprises 7 or more consecutive 2'-F at the 5'-end.

1153. The composition or method of any one of the preceding embodiments, wherein the plurality of oligonucleotides share a common pattern of sugar modification, which comprises 7 or more consecutive 2'-F at the 3'-end.

1154. The composition or method of any one of the preceding embodiments, wherein the plurality of oligonucleotides share a common pattern of sugar modification, which comprises 3 or more consecutive 2'-F at the 5'-end, 3 or more consecutive 2'-F at the 3'-end, and 3 or more 2'-OR between the 5'-end 2'-F and the 3'-end 2'-F modifications.

1155. The composition or method of any one of the preceding embodiments, wherein the plurality of oligonucleotides share a common pattern of sugar modification, which comprises 3 or more 2'-F at the 5'-end, 3 or more 2'-F at the 3'-end, and 3 or more 2'-OR between the 5'-end 2'-F and the 3'-end 2'-F modifications.

1156. The composition or method of any one of the preceding embodiments, wherein the plurality of oligonucleotides share a common pattern of sugar modification, which comprises 5 or more 2'-F within the 10 nucleotides at the 5'-end.

1157. The composition or method of any one of the preceding embodiments, wherein the plurality of oligonucleotides share a common pattern of sugar modification, which comprises 3 or more consecutive 2'-F at the 5'-end.

1158. The composition or method of any one of the preceding embodiments, wherein the plurality of oligonucleotides share a common pattern of sugar modification, which comprises 7 or more 2'-F within the 10 nucleotides at the 3'-end.

1159. The composition or method of any one of the preceding embodiments, wherein the plurality of oligonucleotides share a common pattern of sugar modification, which comprises 5 or more consecutive 2'-F within the 10 nucleotides at the 3'-end.

1160. The composition or method of any one of the preceding embodiments, wherein the plurality of oligonucleotides share a common pattern of sugar modification, which comprises 7 or more consecutive 2'-F at the 3'-end.

1161. The composition or method of any one of the preceding embodiments, wherein the plurality of oligonucleotides comprises a 5'-wing-core-wing-3' structure, wherein each wing region independently comprises 3 to 10 nucleosides, and the core region independently comprises 3 to 10 nucleosides.

1162. The composition or method of any one of the preceding embodiments, wherein the plurality of oligonucleotides comprises a 5'-wing-core-3' or a 5'-core-wing-3' structure, wherein each wing region independently comprises 3 to 10 nucleosides, and the core region independently comprises 3 to 10 nucleosides.

1163. The composition or method of any one of the preceding embodiments, wherein a 5'-wing region comprises 3, 4, 5, 6, 7, 8, 9 or more 2'-F.

1164. The composition or method of any one of the preceding embodiments, wherein a 5'-wing region comprises 3 or more 2'-F.

1165. The composition or method of any one of the preceding embodiments, wherein a 5'-wing region comprises 5 or more 2'-F.

1166. The composition or method of any one of the preceding embodiments, wherein a 5'-wing region comprises 3, 4, 5, 6, 7, 8, 9 or more consecutive 2'-F.

1167. The composition or method of any one of the preceding embodiments, wherein a 5'-wing region comprises 3 or more consecutive 2'-F.

1168. The composition or method of any one of the preceding embodiments, wherein a 5'-wing region comprises 5 or more consecutive 2'-F.

1169. The composition or method of any one of the preceding embodiments, wherein a 5'-wing region comprises 10%, 20%, 30%, 40%, 50%, 60%, 70%, 80%, 90% or more 2'-F.

1170. The composition or method of any one of the preceding embodiments, wherein each sugar of a 5'-wing region comprises a 2'-F.

1171. The composition or method of any one of the preceding embodiments, wherein the lipid is selected from the group consisting of: lauric acid, myristic acid, palmitic acid, stearic acid, oleic acid, linoleic acid, alpha-linolenic acid, gamma-linolenic acid, docosahexaenoic acid (cis-DHA), turbinaric acid and dilinoleyl.

1172. An oligonucleotide described in any one of the preceding embodiments or a salt thereof.

1173. An oligonucleotide described in any one of the Tables or a salt thereof.

1174. An oligonucleotide described in Table 4 or a salt thereof.

1175. The oligonucleotide of embodiment 1173 or 1174, wherein the oligonucleotide is WV-887.

1176. The oligonucleotide of embodiment 1173 or 1174, wherein the oligonucleotide is WV-892.

1177. The oligonucleotide of embodiment 1173 or 1174, wherein the oligonucleotide is WV-896.

1178. The oligonucleotide of embodiment 1173 or 1174, wherein the oligonucleotide is WV-1714.

1179. The oligonucleotide of embodiment 1173 or 1174, wherein the oligonucleotide is WV-2444.

1180. The oligonucleotide of embodiment 1173 or 1174, wherein the oligonucleotide is WV-2445.

1181. The oligonucleotide of embodiment 1173 or 1174, wherein the oligonucleotide is WV-2526.

1182. The oligonucleotide of embodiment 1173 or 1174, wherein the oligonucleotide is WV-2527.

1183. The oligonucleotide of embodiment 1173 or 1174, wherein the oligonucleotide is WV-2528.

1184. The oligonucleotide of embodiment 1173 or 1174, wherein the oligonucleotide is WV-2530.

1185. The oligonucleotide of embodiment 1173 or 1174, wherein the oligonucleotide is WV-2531.

1186. The oligonucleotide of embodiment 1173 or 1174, wherein the oligonucleotide is WV-2578.

1187. The oligonucleotide of embodiment 1173 or 1174, wherein the oligonucleotide is WV-2580.

1188. The oligonucleotide of embodiment 1173 or 1174, wherein the oligonucleotide is WV-2587.

1189. The oligonucleotide of embodiment 1173 or 1174, wherein the oligonucleotide is WV-3047.

1190. The oligonucleotide of embodiment 1173 or 1174, wherein the oligonucleotide is WV-3152.

1191. The oligonucleotide of embodiment 1173 or 1174, wherein the oligonucleotide is WV-3472.

1192. The oligonucleotide of embodiment 1173 or 1174, wherein the oligonucleotide is WV-3473.

1193. The oligonucleotide of embodiment 1173 or 1174, wherein the oligonucleotide is WV-3507.

1194. The oligonucleotide of embodiment 1173 or 1174, wherein the oligonucleotide is WV-3508.

1195. The oligonucleotide of embodiment 1173 or 1174, wherein the oligonucleotide is WV-3509.

1196. The oligonucleotide of embodiment 1173 or 1174, wherein the oligonucleotide is WV-3510.

1197. The oligonucleotide of embodiment 1173 or 1174, wherein the oligonucleotide is WV-3511.

1198. The oligonucleotide of embodiment 1173 or 1174, wherein the oligonucleotide is WV-3512.

1199. The oligonucleotide of embodiment 1173 or 1174, wherein the oligonucleotide is WV-3513.

1200. The oligonucleotide of embodiment 1173 or 1174, wherein the oligonucleotide is WV-3514.

1201. The oligonucleotide of embodiment 1173 or 1174, wherein the oligonucleotide is WV-3515.

1202. The oligonucleotide of embodiment 1173 or 1174, wherein the oligonucleotide is WV-3545.

1203. The oligonucleotide of embodiment 1173 or 1174, wherein the oligonucleotide is WV-3546.

1204. The oligonucleotide of any one of embodiments 1172-1204, wherein the salt is a sodium salt.

1205. The oligonucleotide of any one of embodiments 1172-1204, wherein the salt is a ammonium salt.

1206. The oligonucleotide of any one of embodiments 1172-1206, wherein the salt comprises two or more cations.

1207. A compound having the structure of
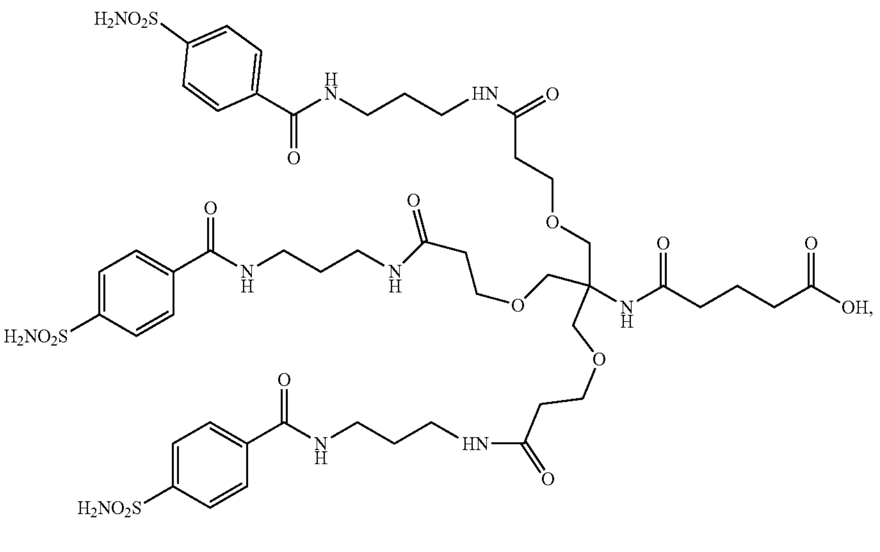 [SMILES: NS(=O)(=O)c1ccc(C(=O)NCCCNC(=O)CCOCC(COCCC(=O)NCCCNC(=O)c2ccc(S(N)(=O)=O)cc2)(COCCC(=O)NCCCNC(=O)c2ccc(S(N)(=O)=O)cc2)NC(=O)CCCC(=O)O)cc1]
1208. A compound having the structure of
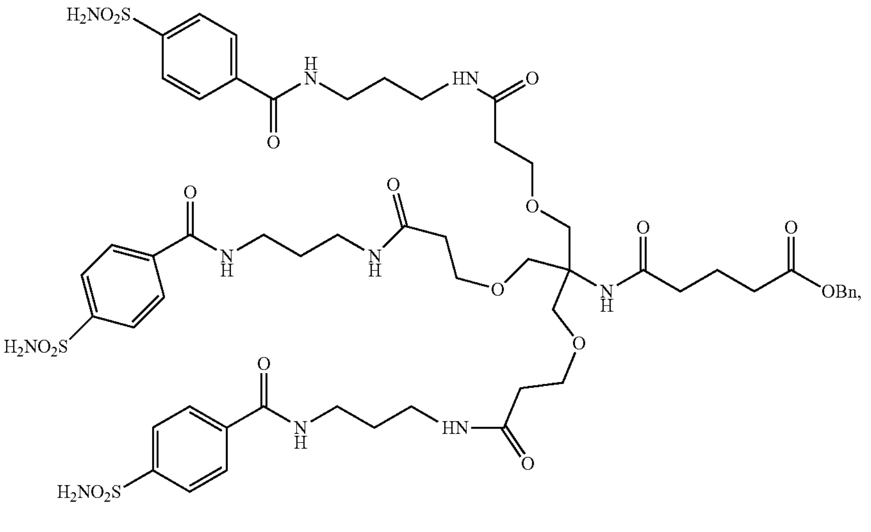 [SMILES: NS(=O)(=O)c1ccc(C(=O)NCCCNC(=O)CCOCC(COCCC(=O)NCCCNC(=O)c2ccc(S(N)(=O)=O)cc2)(COCCC(=O)NCCCNC(=O)c2ccc(S(N)(=O)=O)cc2)NC(=O)CCCC(=O)OCc2ccccc2)cc1]
or a salt thereof.
1209. A compound having the structure of
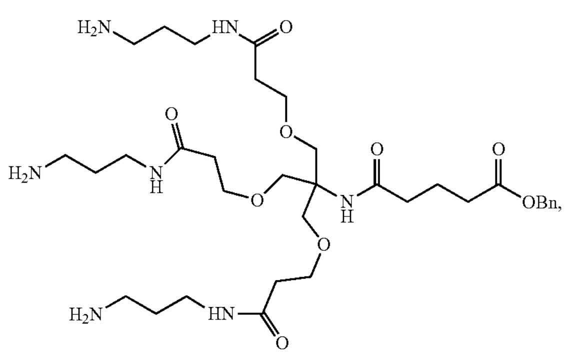 [SMILES: NCCCNC(=O)CCOCC(COCCC(=O)NCCCN)(COCCC(=O)NCCCN)NC(=O)CCCC(=O)OCc1ccccc1]
or a salt thereof.
1210. A compound having the structure of
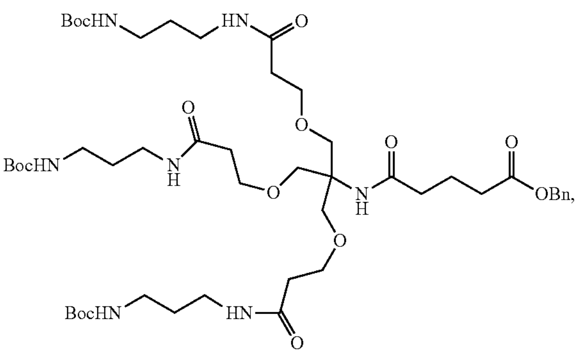 [SMILES: CC(C)(C)OC(=O)NCCCNC(=O)CCOCC(COCCC(=O)NCCCNC(=O)OC(C)(C)C)(COCCC(=O)NCCCNC(=O)OC(C)(C)C)NC(=O)CCCC(=O)OCc1ccccc1]
or a salt thereof.

1211. A compound having the structure of
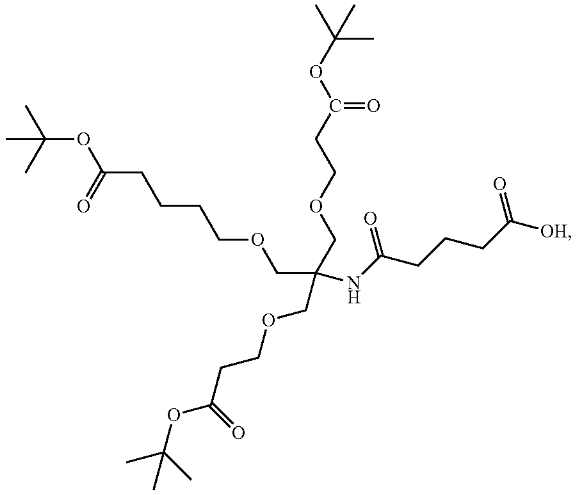 [SMILES: CC(C)(C)OC(=O)CCCCOCC(COCCC(=O)OC(C)(C)C)(COCCC(=O)OC(C)(C)C)NC(=O)CCCC(=O)O]
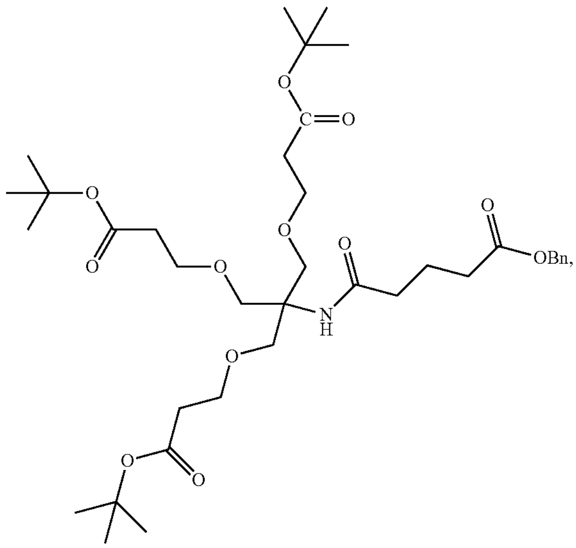
-continued
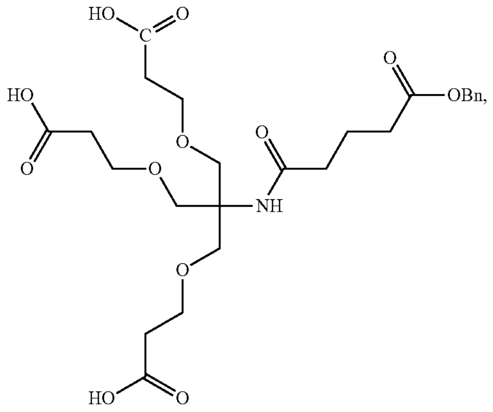
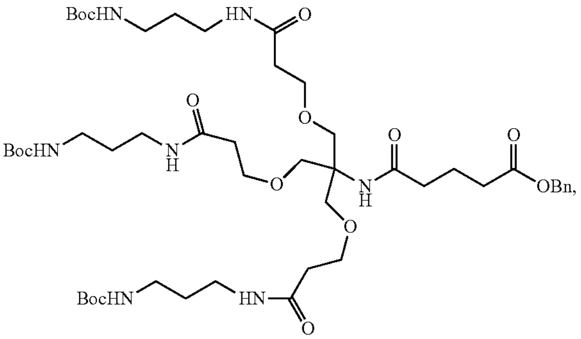
or a salt thereof.
1212. A compound, which is a conjugate of an oligonucleotide and
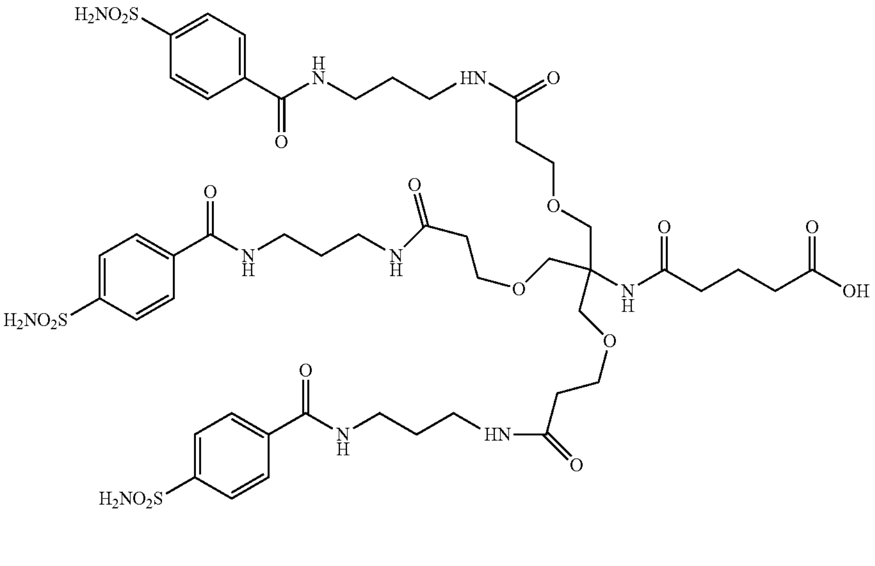 [SMILES: NS(=O)(=O)c1ccc(C(=O)NCCCNC(=O)CCOCC(COCCC(=O)NCCCNC(=O)c2ccc(S(N)(=O)=O)cc2)(COCCC(=O)NCCCNC(=O)c2ccc(S(N)(=O)=O)cc2)NC(=O)CCCC(=O)O)cc1]
or a salt thereof.

1213. A compound, which is an oligonucleotide comprising
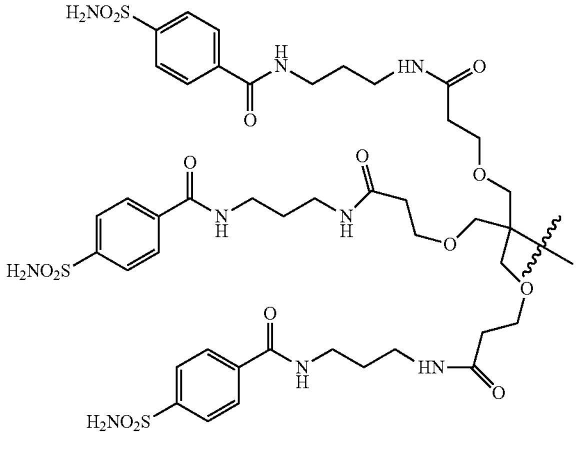 [SMILES: *C(COCCC(=O)NCCCNC(=O)c1ccc(S(N)(=O)=O)cc1)(COCCC(=O)NCCCNC(=O)c1ccc(S(N)(=O)=O)cc1)COCCC(=O)NCCCNC(=O)c1ccc(S(N)(=O)=O)cc1]
or a salt thereof.
1214. A compound having the structure of:
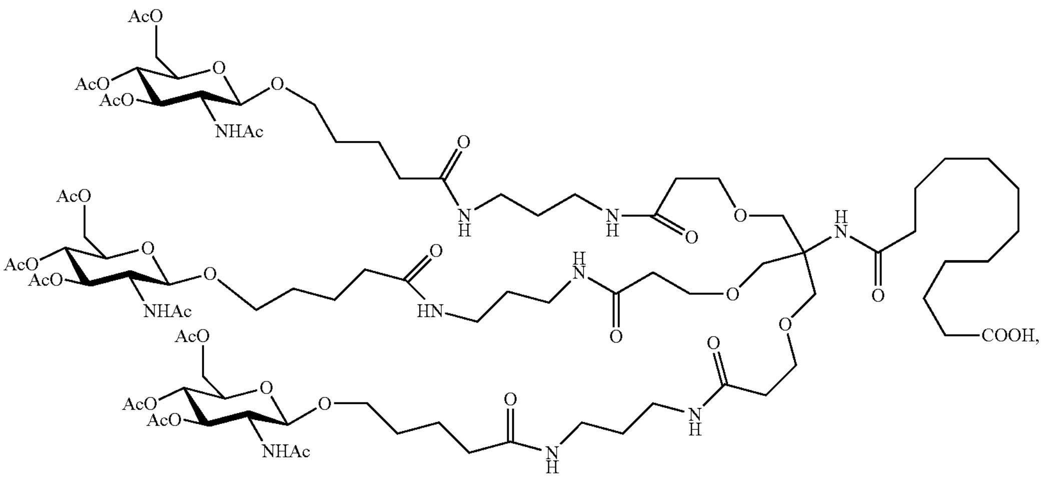
or a salt thereof.
1215. A compound having the structure of:
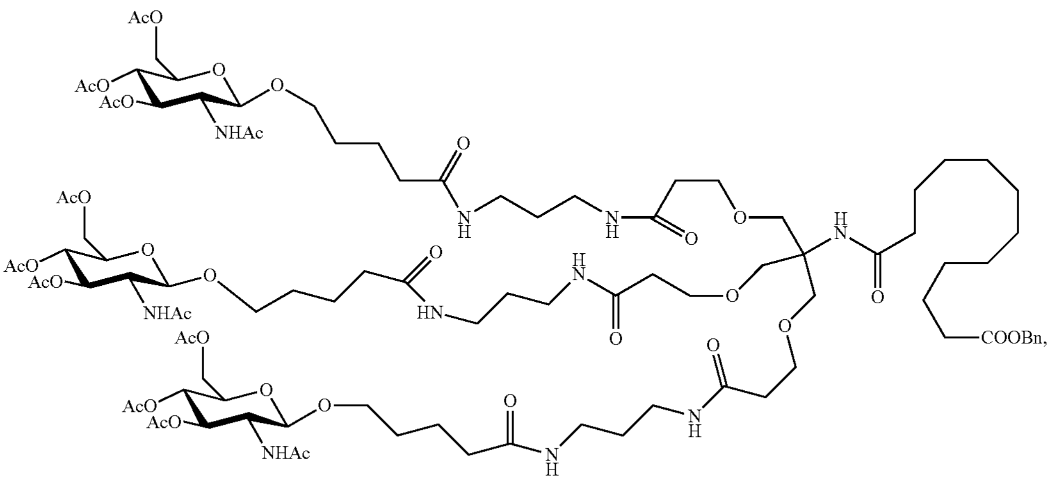
or a salt thereof.

1216. A compound having the structure of:
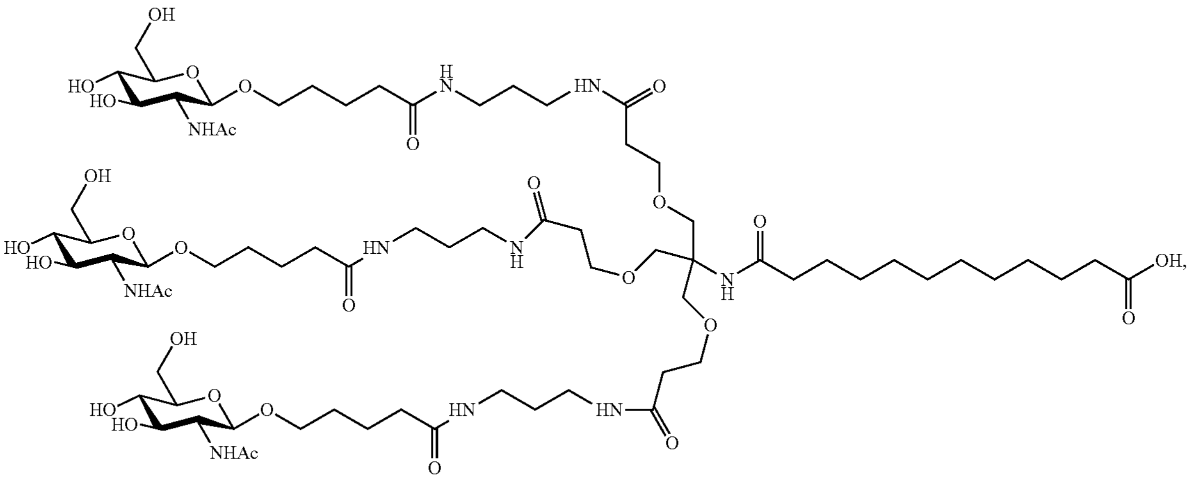
or a salt thereof.
1217. A compound, which is a conjugate of an oligonucleotide and
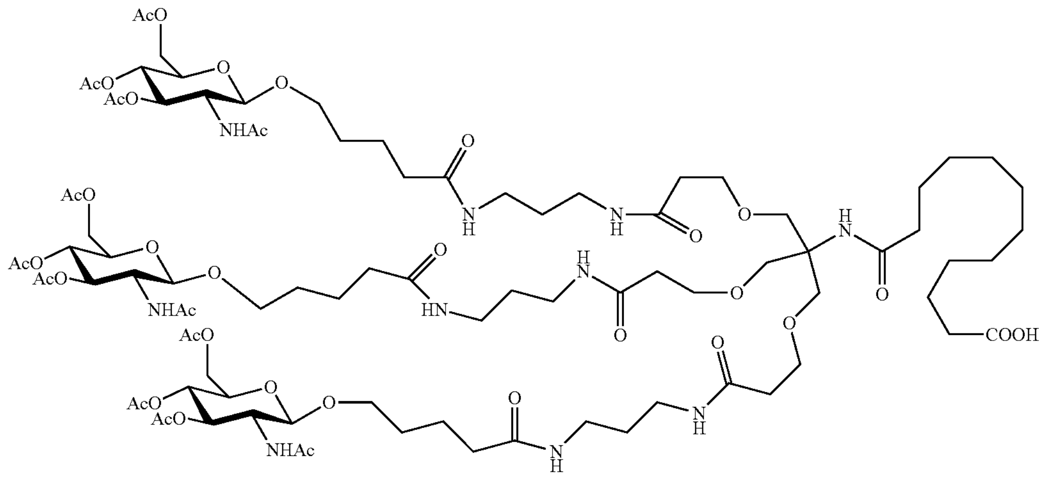
or a salt thereof.

1218. A compound, which is a conjugate of an oligonucleotide and
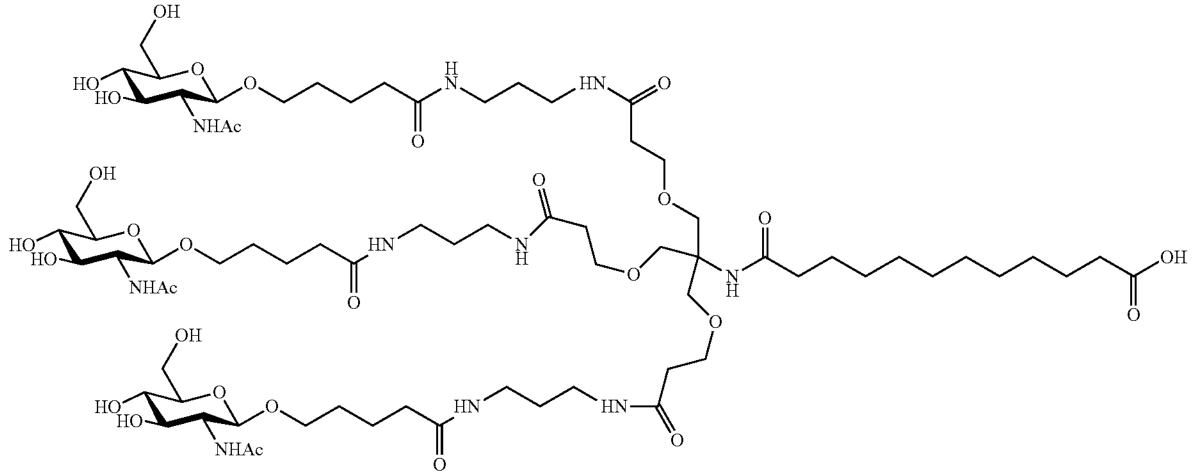
or a salt thereof.
1219. A compound, which is an oligonucleotide comprising
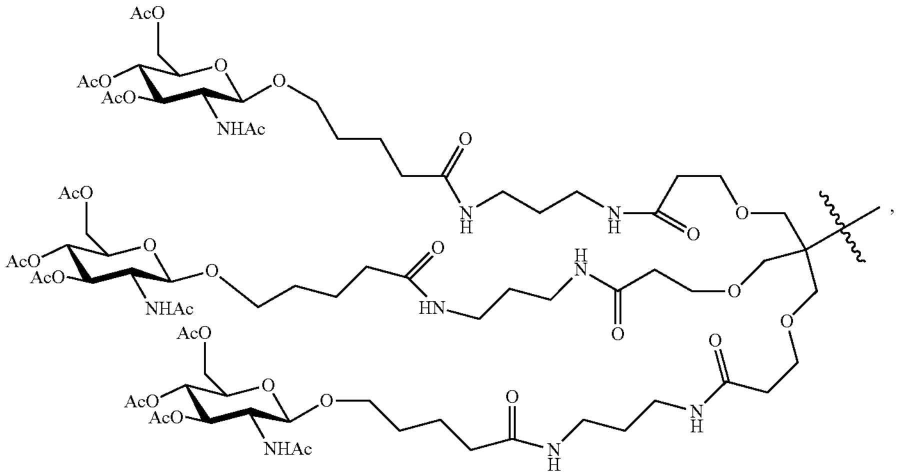
,
or a salt thereof.

1220. A compound, which is an oligonucleotide comprising

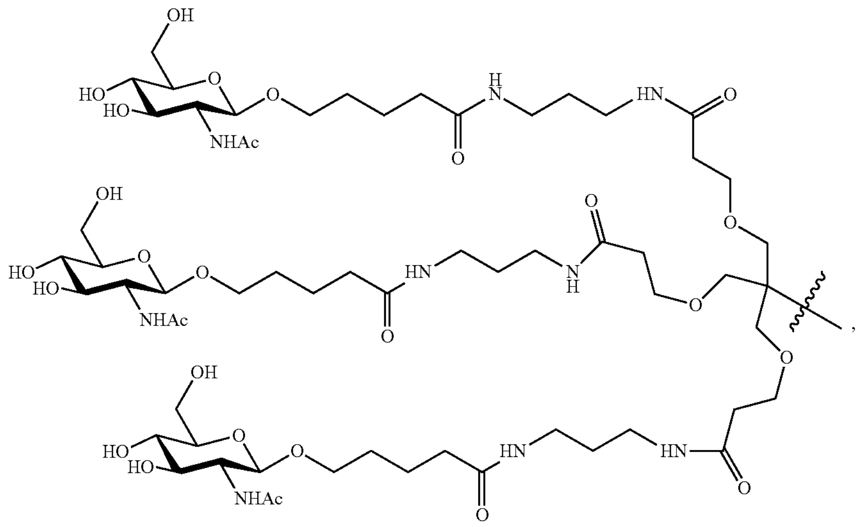

or a salt thereof.

1221. The compound of any one of embodiments 1175-1220, wherein the compound has a purity of at least 10%, 20%, 30%, 40%, 50%, 60%, 70%, 75%, 80%, 81%, 82%, 83%, 84%, 85%, 86%, 87%, 88%, 89%, 90%, 91%, 92%, 93%, 94%, 95%, 96%, 97%, 97% or 99%.

1222. The compound of any one of embodiments 1175-1221, wherein the compound has a purity of at least 90%.

1223. A composition, comprising a compound of any one of embodiments 1175-1222.

EXEMPLIFICATION

The foregoing has been a description of certain non-limiting embodiments of the disclosure. Accordingly, it is to be understood that the embodiments of the disclosure herein described are merely illustrative of the application of the principles of the disclosure. Reference herein to details of the illustrated embodiments is not intended to limit the scope of the claims.

Methods for preparing provided oligonucleotides and oligonucleotide compositions are widely known in the art, including but not limited to those described in WO/2010/064146, WO/2011/005761, WO/2013/012758, WO/2014/010250, US2013/0178612, WO/2014/012081 and WO/2015/107425, the methods and reagents of each of which are incorporated herein by reference. Applicant describes herein example methods for making provided oligonucleotides.

The function and advantage of these and other embodiments of the present disclosure will be more fully understood from the examples described below. The following examples are intended to illustrate the benefits of the present disclosure, but do not exemplify the full scope of the disclosure.

Example 1. Example Preparation of Linkers

In some embodiments, an SP linker was prepared following the scheme below:

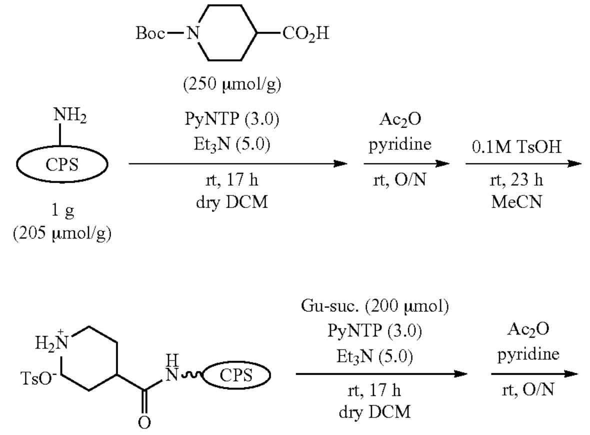

-continued

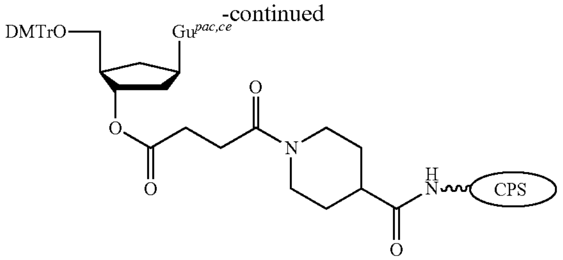

160 μmol/g

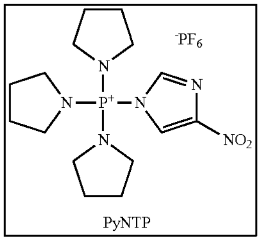

PyNTP

Example 2. Example Methods for Preparing Oligonucleotides and Compositions

Abbreviation

AMA: conc. $NH_3$ —40% $MeNH_2$ in $H_2O$ (1:1, v/v)
CMIMT: N-cyanomethylimidazolium triflate
DBU: 1,8-diazabicyclo[5.4.0]undec-7-ene
DCA: dichloroacetic acid
DCM: dichloromethane, $CH_2Cl_2$
DMTr: 4,4'-dimethoxytrityl
DVB: divinylbenzene
HCP: highly cross-linked polystyrene (contains 50% DVB, non-swelling polystyrene)
MeIm: N-methylimidazole
MQ: water obtained from "Milli-Q Reference"
PhIMT: N-phenylimidazolium triflate
POS: 3-phenyl-1,2,4-dithiazolin-5-one
PS200: primer support 200, commercially available from GE Healthcare
PS5G: primer support 5G, commercially available from GE Healthcare
TBAF: tetrabutylammonium fluoride
TBHP: tert-butylhydroperoxide
TEAA: triethylammonium acetate General Procedure for the Synthesis of Chirally Controlled Oligonucleotide Compositions (1 μmol Scale):

Various types of solid support (with varied nucleosides loading), linkers, activators, etc. can be used. In some embodiments, a solid support is HCP. In some embodiments, a solid support is PS5G. In some embodiments, a solid support is PS200. In some embodiments, a solid support is CPG. In some embodiments, during preparation of chirally controlled oligonucleotide compositions by using DPSE-type chemistry, SP-linker was used. In some embodiments, CMIMT was used.

An example procedure for the synthesis of oligonucleotides (1 μmol scale) is described below.

In some embodiments, automated solid-phase synthesis of oligonucleotides was performed on HCP polystyrene solid support according to the cycles shown below. After synthesis, the resin was treated with, e.g., 0.1M TBAF in MeCN (1 mL) for 2 h (30 min usually enough) at room temperature, washed with MeCN, dried, and add AMA (1 mL) for 30 min at 45° C. The mixture was cooled to room temperature and the resin was removed by membrane filtration. The filtrate was concentrated under reduced pressure until it about 1 mL. The residue was diluted with 1 mL of $H_2O$ and analyzed by AEX-HPLC and RP-UPLC-MS.

| step | operation | reagents and solvent | volume | waiting time |
| --- | --- | --- | --- | --- |
| 1 | detritylation | 3% DCA in toluene | 10 mL | 65 s |
| 2 | coupling | 0.15M monomer in $^{i}$PrCN* + 0.5M CMIMT in MeCN | 0.5 mL | 5 min |
| 3 | capping | 20% $Ac_2O$, 30% 2,6-lutidine in MeCN + 20% MeIm in MeCN | 1.2 mL | 60 s |
| 4 | oxidation or sulfurization | 1.1M TBHP in DCM-decane or 0.1M POS in MeCN | 1.0 mL | 300 s |

*monomers are dissolved in iso-butyronitrile

Example Analytical conditions:

1) RP-UPLC-MS
   System: Waters, Aquity UPLC I-Class, Xevo G2-Tof
   Column: Waters, BEH C18, 1.7 μm, 2.1×150 mm
   Temp. & Flow rate: 55° C., 0.3 mL/min
   Buffer: A: 0.1M TEAA; B: MeCN
   Gradient: % B: 1-30%/30 min
2) AEX-HPLC
   System: Waters, Alliance e2695
   Column: Thermo, DNAPac PA-200, 4×250 mm
   Temp. & Flow rate: 50° C., 1 mL/min
   Buffer: A: 20 mM NaOH; B: A+1M $NaClO_4$
   Gradient: % B: 10-50%/30 min Example procedure for the purification of oligonucleotides (1 μmol scale): in some embodiments, crude oligos were purified by AEX-MPLC according to the following example conditions:

System: AKTA Purifier-10
Column: TOHSOH, DNA STAT, 4.6×100 mm
Temp. & Flow rate: 60° C., 0.5 mL/min
Buffer: A: 20 mM Tris-HCl (pH 9.0)+20% MeCN, B: A+1.5M NaCl
Gradient: % B: 20-70%/25CV (2%/CV)

All fractions were analyzed by analytical AEX-HPLC, and fractions containing oligonucleotides more than 80% purity were collected and desalted by Sep-Pak Plus tC18 (WAT036800) shown below conditions:

1. Conditioning Sep-Pak Plus with 15 mL of MeCN.
2. Rinse cartridge with 15 mL of 50% MeCN/MQ.
3. Equilibrate cartridge with 30 mL of MQ.
4. Load sample, and wash with 40 mL of MQ.
5. Elute chiral oligos with 10 mL of 50% MeCN/MQ.

Eluted sample were evaporated under reduced pressure to remove MeCN and lyophilized. The product were dissolved in MQ (1 mL), filtered by 0.2 μm mesh syringe filter, and analyzed. After yield calculation by UV absorbance, the preparation was lyophilized again.

In some embodiments, iso-butyronitrile (also known as isobutyronitrile, 2-Methylpropanenitrile, 2-Methylpropionitrile, Isopropyl cyanide, or IBN) can be used in the method of preparing a chirally controlled oligonucleotide composition, e.g., as a solvent or co-solvent to dissolve a chiral phosphoramidite. In some embodiments, a solvent comprises or is IBN. In some embodiments, a solvent comprises IBN and ACN (acetonitrile). In some embodiments, a solvent is a mixture of IBN and ACN. In some embodiments, the properties of IBN can provide improved solubility and/or enhanced reactivity during the coupling step of the synthesis cycle (e.g., compared to acetonitrile, also known as ACN).

In some embodiments, this improvement can allow for lower temperatures required for amidite dissolution when compared with those required to obtain solubility in MeCN as well as enabling a range of IBN solution concentrations, possibly leading to shorter coupling times, a more efficient coupling, and less waste generated. In some embodiments, the coupling step of the synthesis cycle can be performed in a mixture of iso-butyronitrile and acetonitrile. In some embodiments, the present disclosure provides a method of preparing a chirally controlled oligonucleotide composition, wherein the method comprises the step of coupling a chiral phosphoramidite that has been dissolved in a solvent comprising iso-butyronitrile with a nucleotide or oligonucleotide. In some embodiments, the present disclosure provides a method of preparing a chirally controlled oligonucleotide composition, wherein the method comprises the step of coupling a nucleotide or oligonucleotide with a chiral phosphoramidite in a solvent comprising iso-butyronitrile. In some embodiments, the present disclosure provides a method of preparing a chirally controlled oligonucleotide composition, wherein the method comprises the step of coupling a nucleotide or oligonucleotide with a chiral phosphoramidite in a solvent comprising iso-butyronitrile and acetonitrile. In various embodiments, a chiral phosphoramidite can be dissolved in a solvent comprising a compound having the structure of: R—CN, where R is optionally alkyl, substituted alkyl, cycloalkyl or aryl. In some embodiments, the compound of formula R—CN is selected from butyronitrile, propionitrile, valeronitrile, or heptyl cyanide. In some embodiments, the present disclosure provides a method of preparing a chirally controlled oligonucleotide composition, wherein the method comprises the step of coupling a chiral phosphoramidite that has been dissolved in a solvent comprising a compound of formula R—CN with a nucleotide or oligonucleotide. In some embodiments, the present disclosure provides a method of preparing a chirally controlled oligonucleotide composition, wherein the method comprises the step of coupling a nucleotide or oligonucleotide with a chiral phosphoramidite in a solvent comprising one or more compounds of formula R—CN. In various embodiments, the nucleotide is modified or unmodified.

Example methods, conditions and reagents were described in, e.g., JP 2002-33436, WO2005/092909, WO2010/064146, WO2012/039448, WO2011/108682, WO2014/010250, WO2014/010780, WO2014/012081, WO/2015/107425, etc., and may be useful for preparing provided oligonucleotides and/or compositions.

Provided compositions, among other things, demonstrated improved properties including improved stability and activities. For example, provided oligonucleotide compositions provided increased cleavage rates, increased selectivity, enhanced cleavage pattern, altered splicing of transcripts, etc.

Example 3. Provided Compositions and Methods Alter Splicing

Provided compositions, among other things, demonstrated improved properties including improved stability and activities. For example, provided oligonucleotide compositions provided increased cleavage rates, increased selectivity, enhanced cleavage pattern, altered splicing of transcripts, etc. In some embodiments, provided compositions and methods are particularly effective in altering splicing of transcripts, so that beneficial splicing products, such as mRNA, can be produced at higher levels to increase, repair, restore, and/or add desired beneficial biological functions. For example, in some embodiments, provided compositions and methods can be used to skip disease-causing exon 51 of DMD to provide mRNA and proteins which have improved biological activities compared to when exon 51 is not skipped.

Assays for assessing splicing of transcripts are well known in the art and widely practiced by persons having ordinary skill in the art. For example, to assess skipping efficiency of exon 51, various assays, such as nested PCR, qPCR, quantitative RT-PCR, etc., can be utilized. In some embodiments, an assay is nested PCR. An example protocol for nested PCR is described below.

For nested PCR, RNA was reverse transcribed using Superscript III One-step RT-PCR kit from Invitrogen. Resulting cDNA was amplified sequentially using two sets of primers, e.g., for nested PCR. PCR products were examined and visualized on agarose gels, and demonstrated that provided compositions can effectively provide skipping of exon 51 to produce the desired mRNA splicing variant.

In some embodiments, an assay for assessing splicing is a Taqman assay. In some embodiments, an assay for assessing splicing is a Taqman quantitative RT-PCR assay. An example procedure is described below.

Procedure of Taqman assay for DMD skipping: Total cellular RNA was first reverse-transcribed into cDNA using High-Capacity RNA-to-cDNA™ Kit from ThermoFisher Scientific following the protocol provided by the vendor. Skipped and unskipped transcripts in the cDNA were preamplified for 14 cycles using TaqMan® PreAmp Master Mix from ThermoFisher Scientific following the protocol provided by the vendor. The amplification procedures were 95° C. for 10 min, then 14 cycles of 95° C. for 15 sec and 60° C. for 4 min. Preamplified cDNA was then analyzed for 40 cycles on LightCycler system (Roche). The conditions were 95° C. for 10 min, followed by 40 cycles of 95° C. for 15 sec and 60° C. for 1 min. Each reaction contained 5 μL of preamplified cDNA, 0.5 μL of Taqman assay for skipped or unskipped DMD transcript, 0.5 μL of Taqman assay for endogenous control, 4 μL water and 10 μL of Taman universal PCR master mix in a total volume of 20 μL. Data were analyzed using the LightCycler program to calculate Ct values. Endogenous controls include HRPT1, GAPDH, as well as muscle differentiation markers such as MyoD, desmin, myogenin, utrophin, myosin heavy chain, DMD itself, etc. Example methods were also described in Anthony et al., Exon skipping quantification by quantitative reverse-transcription polymerase chain reaction in Duchenne muscular dystrophy patients treated with the antisense oligomer eteplirsen, *Hum Gene Ther Methods.* 2012 October; 23(5): 336-45.

Custom TaqMan assays were synthesized by Life Technologies. Below were example sequences:

Unskipped (exon 51):
Forward:
(SEQ ID NO: 1066)
GTGATGGTGGGTGACCTTGAG

Reverse:
(SEQ ID NO: 1067)
TTTGGGCAGCGGTAATGAG

Probe:
(SEQ ID NO: 1068)
CAAGCAGAAGGCAACAA

-continued

```
Skipped (exon 51):
Forward:
                                  (SEQ ID NO: 1069)
TGAAAATAAGCTCAAGCAGACAAATC

Reverse:
                                  (SEQ ID NO: 1070)
GACGCCTCTGTTCCAAATCC

Probe:
                                  (SEQ ID NO: 1071)
CAGTGGATAAAGGCAACA
```

Example data are presented below:

| Sequence ID | Fold change compared to WV-942 |
|---|---|
| WV-942 | 1.00 |
| ONT-395 | 0.03 |
| WV-884 | 1.22 |
| WV-885 | 1.07 |
| WV-886 | 0.83 |
| WV-887 | 0.04 |
| WV-888 | 28.11 |
| WV-889 | 0.05 |
| WV-890 | 0.08 |
| WV-891 | 0.56 |
| WV-892 | 8.33 |
| WV-893 | 0.03 |
| WV-894 | 0.01 |
| WV-895 | 0.37 |
| WV-896 | 4.89 |
| WV-897 | 0.01 |

As shown above in the Figures, provided compositions and methods can alter splicing of a transcript to unexpected levels. For example, WV-888 surprisingly increased DMD exon 51 skipping by almost 30 folds! Additional data, including further improved activities, were illustrated in the Figures.

Example 4. Example Assays for Assessing Skipping

Various assays can be utilized to assess properties of provided oligonucleotides and compositions in accordance with the present disclosure. The present example describes one such example.

Cell treatments and RNA extraction: Primary human myoblasts derived from a patient with deletion of DMD exon 48-50 were seeded into 12-well-plate pre-coated with matrigel (BD Biosciences) with a density of $60\times10^3$ cells per well in muscle cell proliferation medium (PromoCell GmbH, Heidelberg, Germany) at 37° C. with 5% $CO_2$. The next day, proliferation medium was replaced with muscle differentiation medium (DMEM with 5% horse serum) containing 10 µM oligonucleotides to be tested. Cells were differentiated for 4 days. Differentiation medium was then removed from each well and replaced with 500 µL of Trizol. Total RNA was extracted with 300 µL of phenol/chloroform, precipitated with 250 µL isopropanol, washed with 800 µL of 75% ethanol, and finally dissolved in 50 µL RNase free water.

Procedure of nested PCR and Taqman assay for DMD skipping: Total cellular RNA was first reverse-transcribed into cDNA using the High-Capacity RNA-to-cDNA™ Kit from ThermoFisher Scientific following the protocol provided by the vendor. For nested PCR, resulting cDNA was amplified sequentially using two sets of primers for nested PCR. PCR products were examined and visualized on agarose gels. For the Taqman assay, an example procedure was described in the above example.

As demonstrated by example data in the Figures, provided oligonucleotide and compositions provided greatly improved properties, including unexpectedly high skipping efficiencies.

Example 5. Provided Compositions and Methods have Low Toxicity

Among other things, provided compositions have low toxicities. In some embodiments, provided compositions have low complement activation as demonstrated herein.

Effects of oligonucleotides on complement activation were measured in vitro in Cynomolgus monkey serum. The third complement component, C3, is central to the classical, alternative and lectin pathways of complement activation. During complement activation, C3 is proteolytically cleaved resulting in release of the anaphylatoxic peptide C3a. Upon activation of the alternative pathway, Factor B is cleaved by complement Factor D yielding the noncatalytic chain Ba and the catalytic subunit Bb. The active subunit Bb is a serine protease that associates with C3b to form the alternative pathway C3 convertase.

Serum from 3 individual Cynomolgus male monkeys was pooled and the pool was used. The time course of C3a and Bb complement activation was measured by incubating oligonucleotides at 37° C. at a final concentration of 330 ug/mL in Cynomolgus monkey serum (1:10 ratio, V/V) and taking aliquots at the indicated time points. Specifically, 9.24 µL of 10 mg/mL stock of oligonucleotide were added to 270.76 µL of pooled serum, incubated at 37° C. At the indicated time points, 20 µL aliquots were taken out and the reaction was immediately terminated by addition of 2.2 µL of 18 mg/mL EDTA (Sigma-Aldrich).

For the dose response curves six ⅓ serial dilutions (10× concentrated) of oligonucleotides in water were prepared starting from 1 mg/mL. 2 µL of diluted oligonucleotide solutions were then added to 18 µL of Cynomolgus monkey serum and incubated at 37° C. After 40 min the reaction was immediately terminated by addition of 2.2 µL of 18 mg/mL EDTA (Sigma-Aldrich). C3a and Bb were measured using MicroVue C3a Plus and Bb Plus Enzyme Immunoassays from (Quidel, San Diego, CA) at 1:3000 (C3a) and 1:40 (Bb) dilution.

Figure 1:
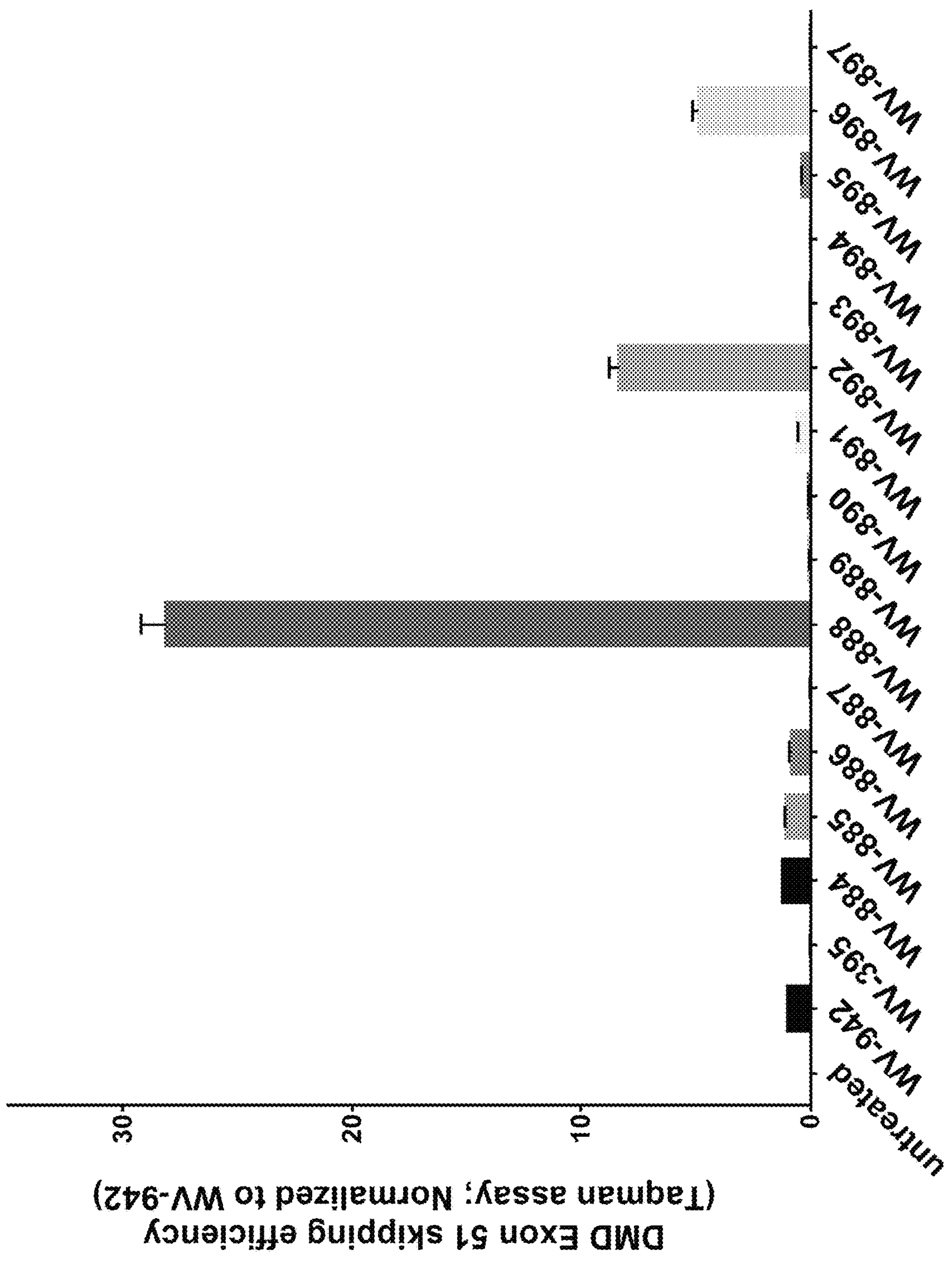
FIG. 1 showed relative activity of oligonucleotides inducing exon 51 skipping in human DMD patient derived fibroblasts that bear A48-50 deletion (DMD cells with del48-50). The result was normalized to randomer WV-942. Taqman assay employed specifically detects DMD transcript with exon 51 skipped.
Figure 2:
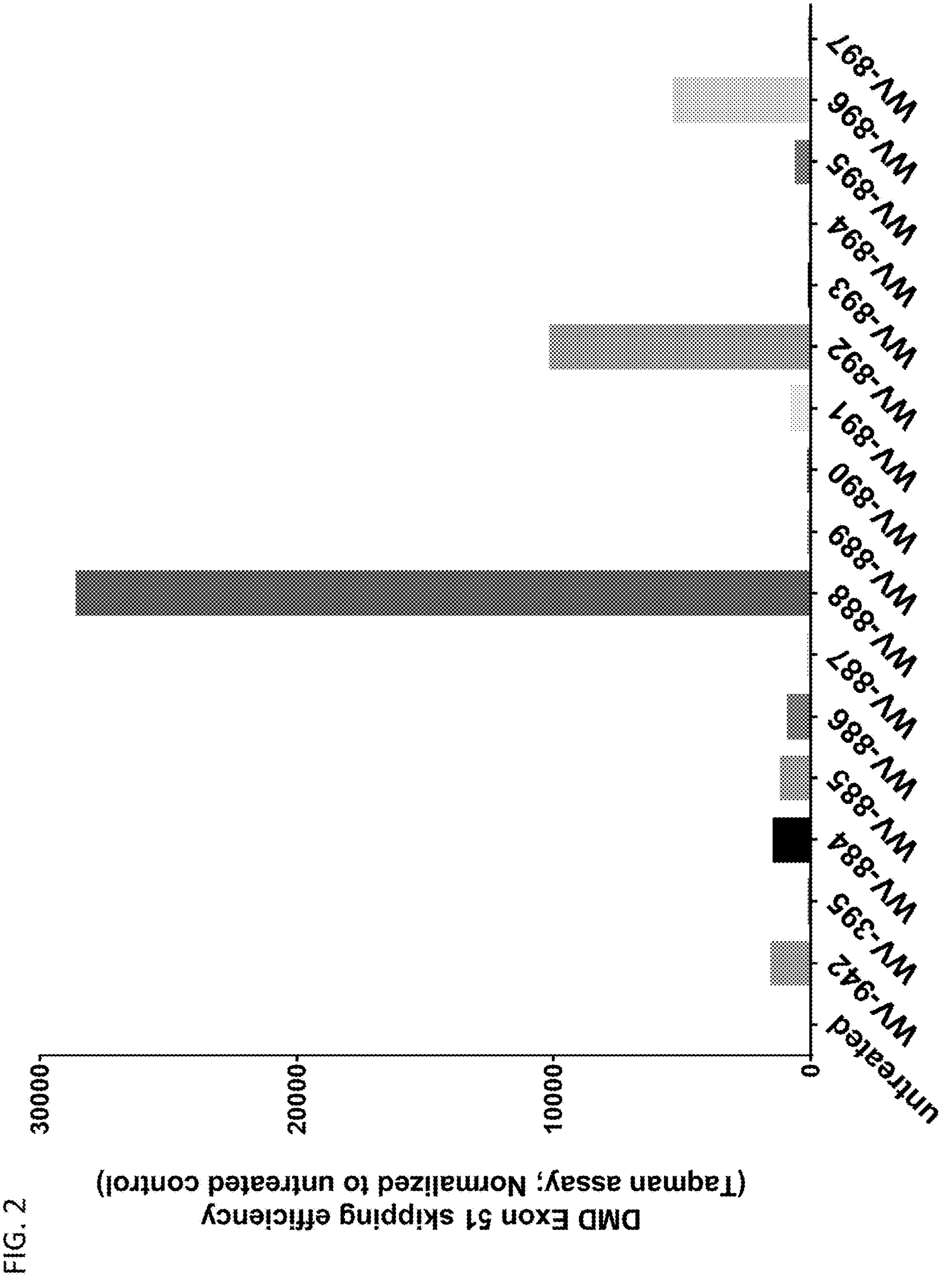
FIG. 2 showed relative activity of oligonucleotides inducing exon 51 skipping in human DMD patient derived fibroblasts that bear A48-50 deletion. The result was normalized to untreated control. Taqman assay employed specifically detects DMD transcript with exon 51 skipped.
Figure 3A:
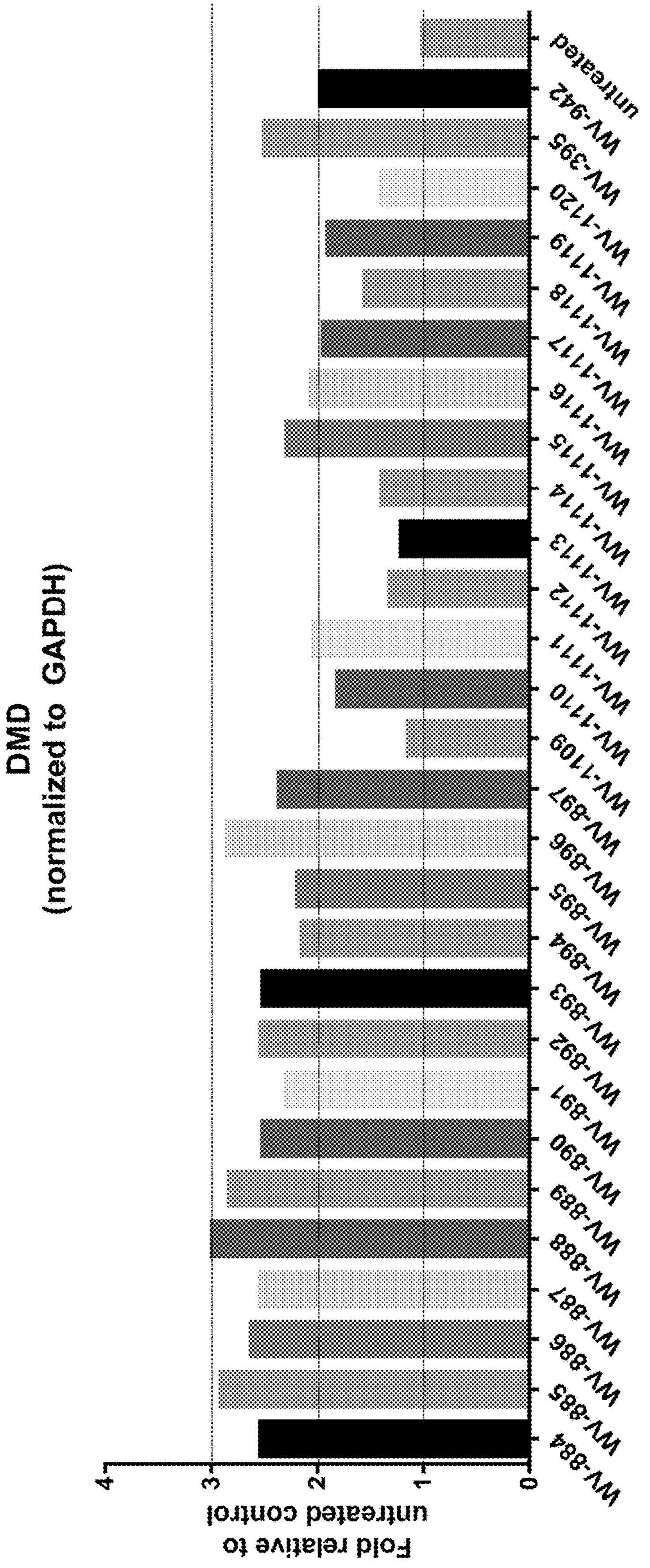
FIGS. 3A to 3F showed expression of muscle differentiation markers relative to untreated controls in differentiated human DMD fibroblasts with or without oligonucleotide treatments. Taqman assays specific for DMD, DES, MYOD1, MYOG, MYH1 and RYR1 were used.
Figure 3B:
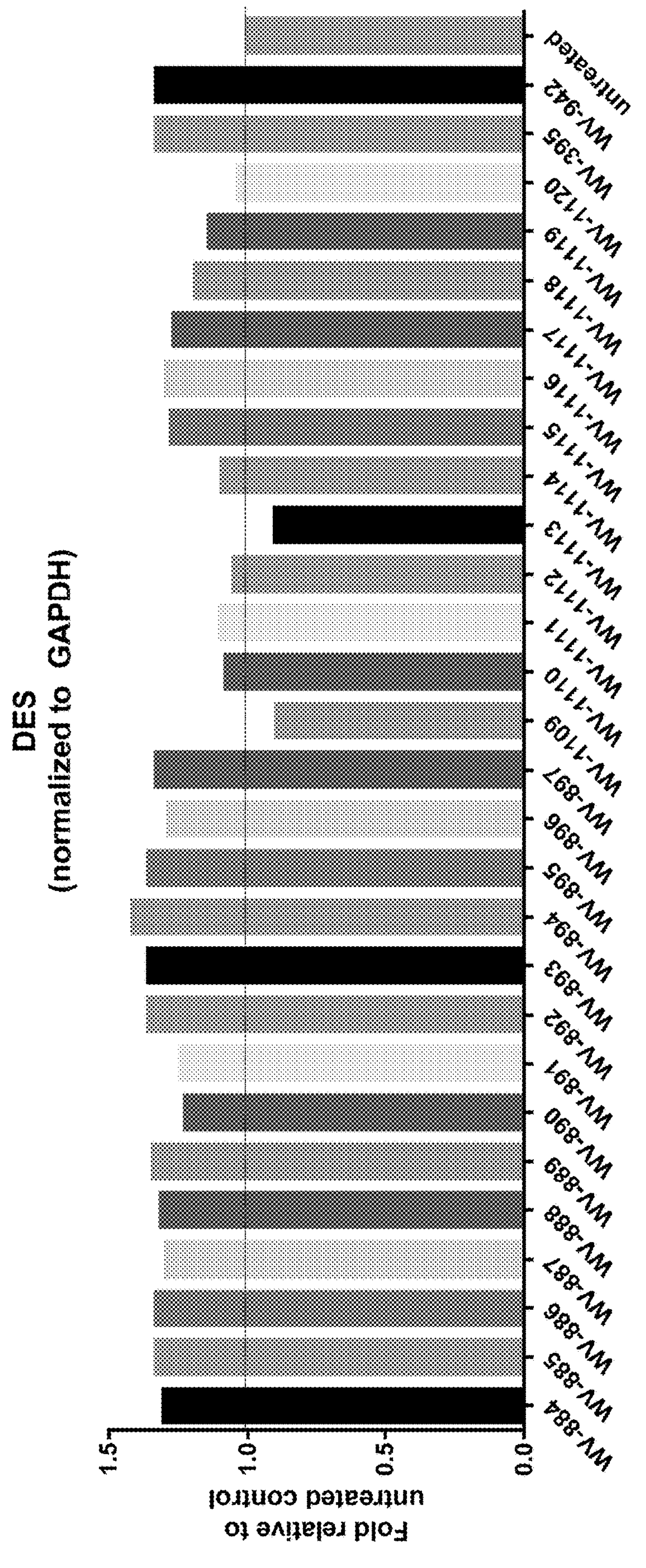
Figure 3C:
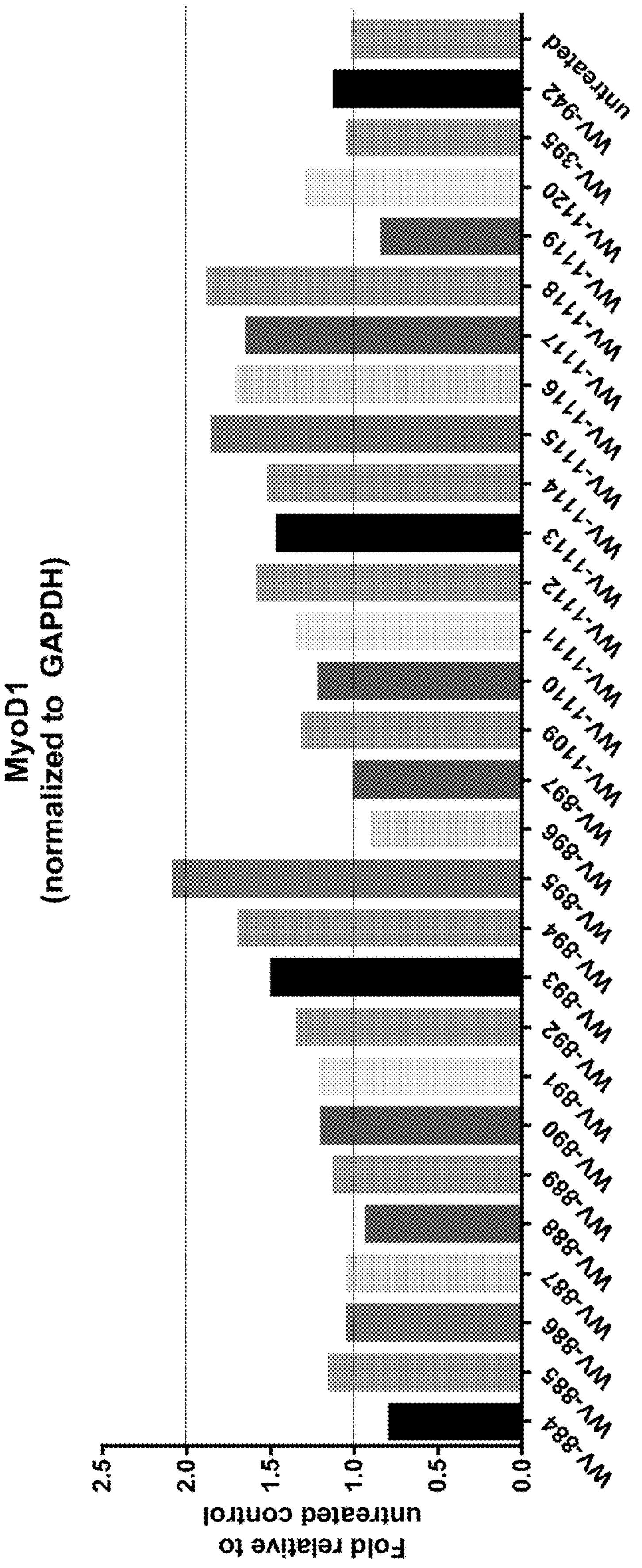
Figure 3D:
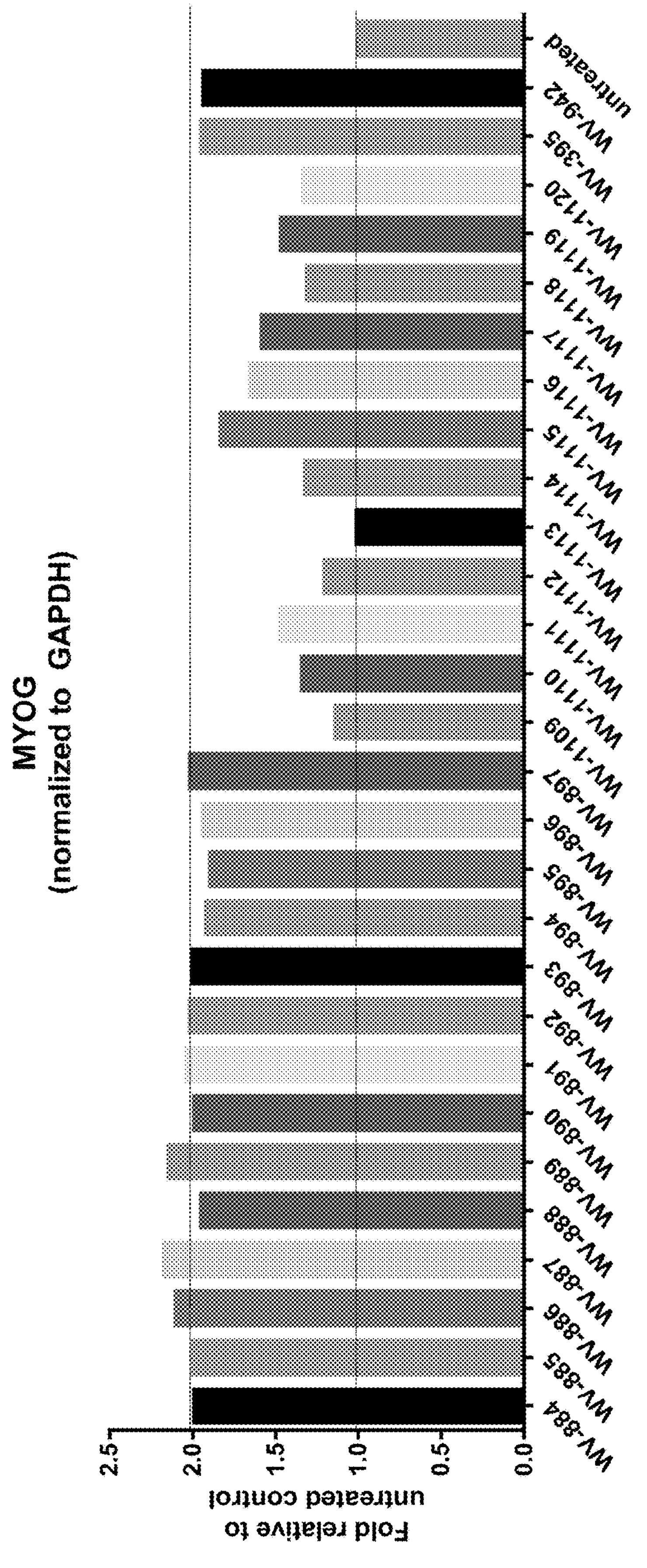
Figure 3E:
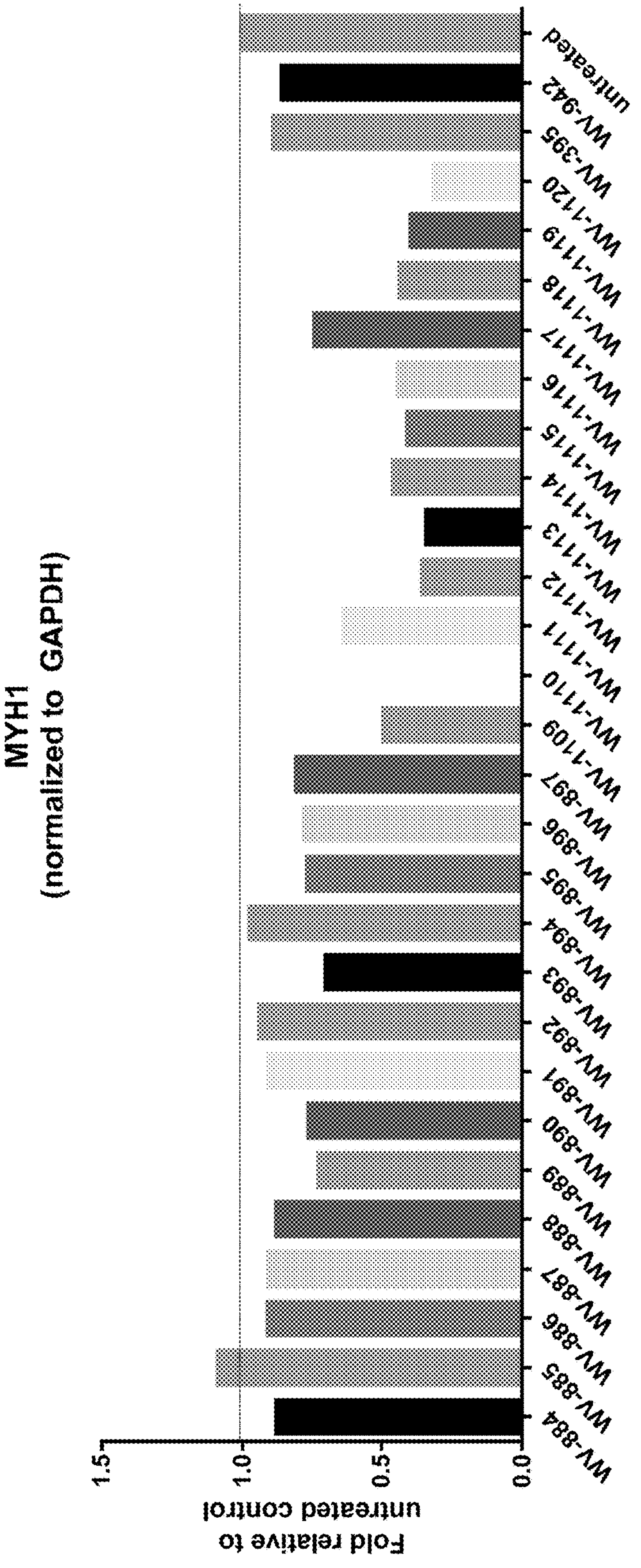
Figure 3F:
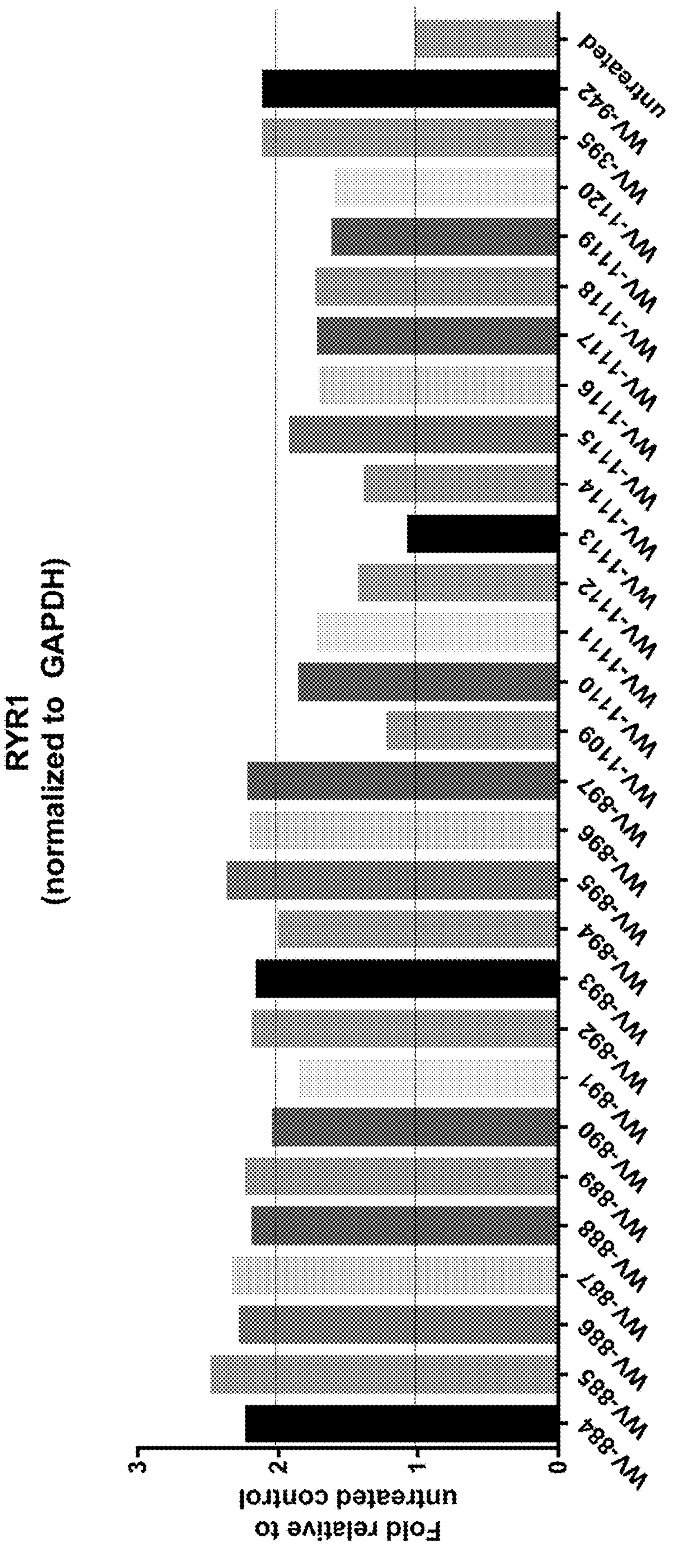
Figure 4:
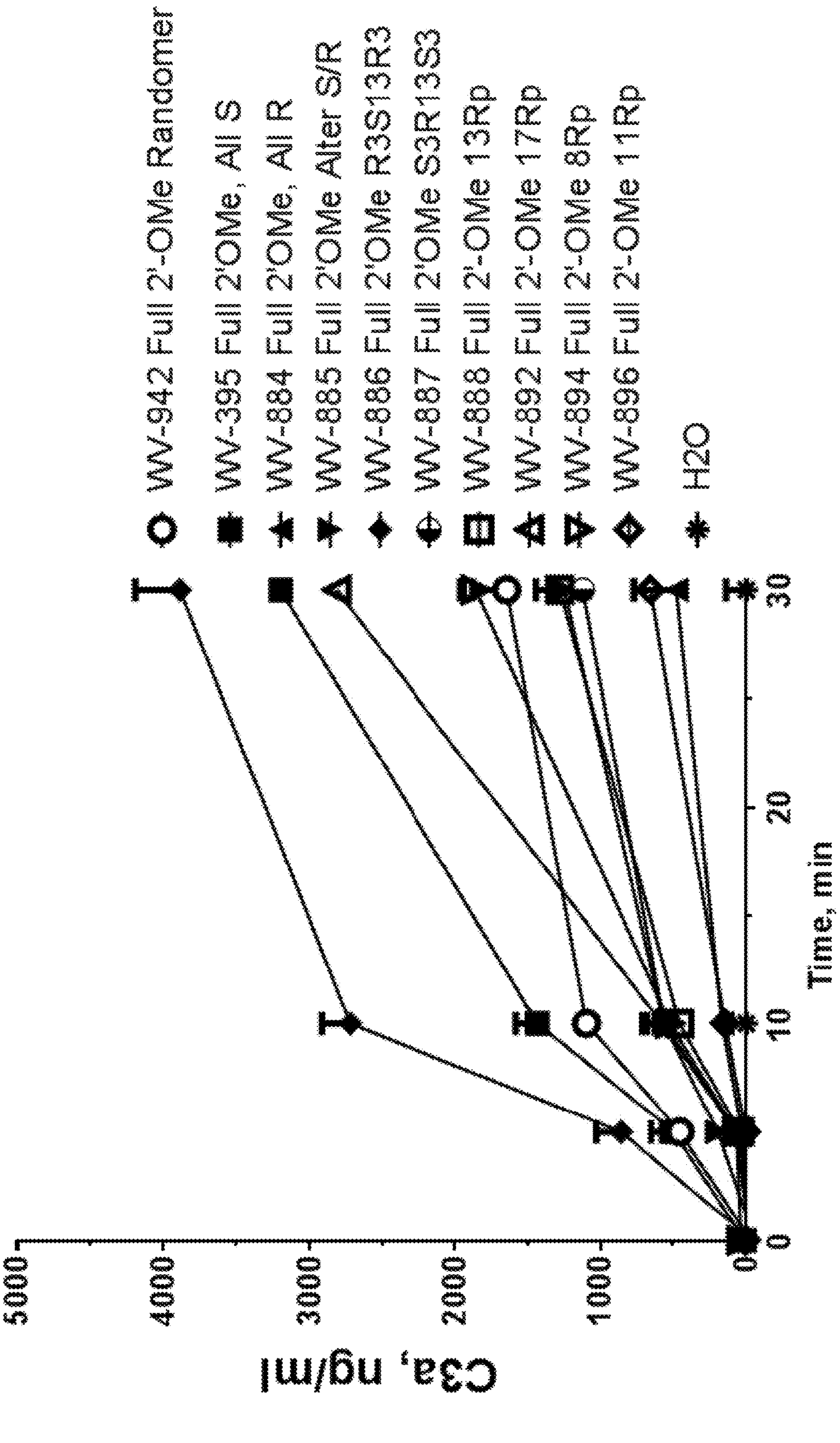
FIG. 4. Example time course of C3a complement activation. Oligonucleotide concentration: 330 μg/mL; 37° C.
Figure 5:
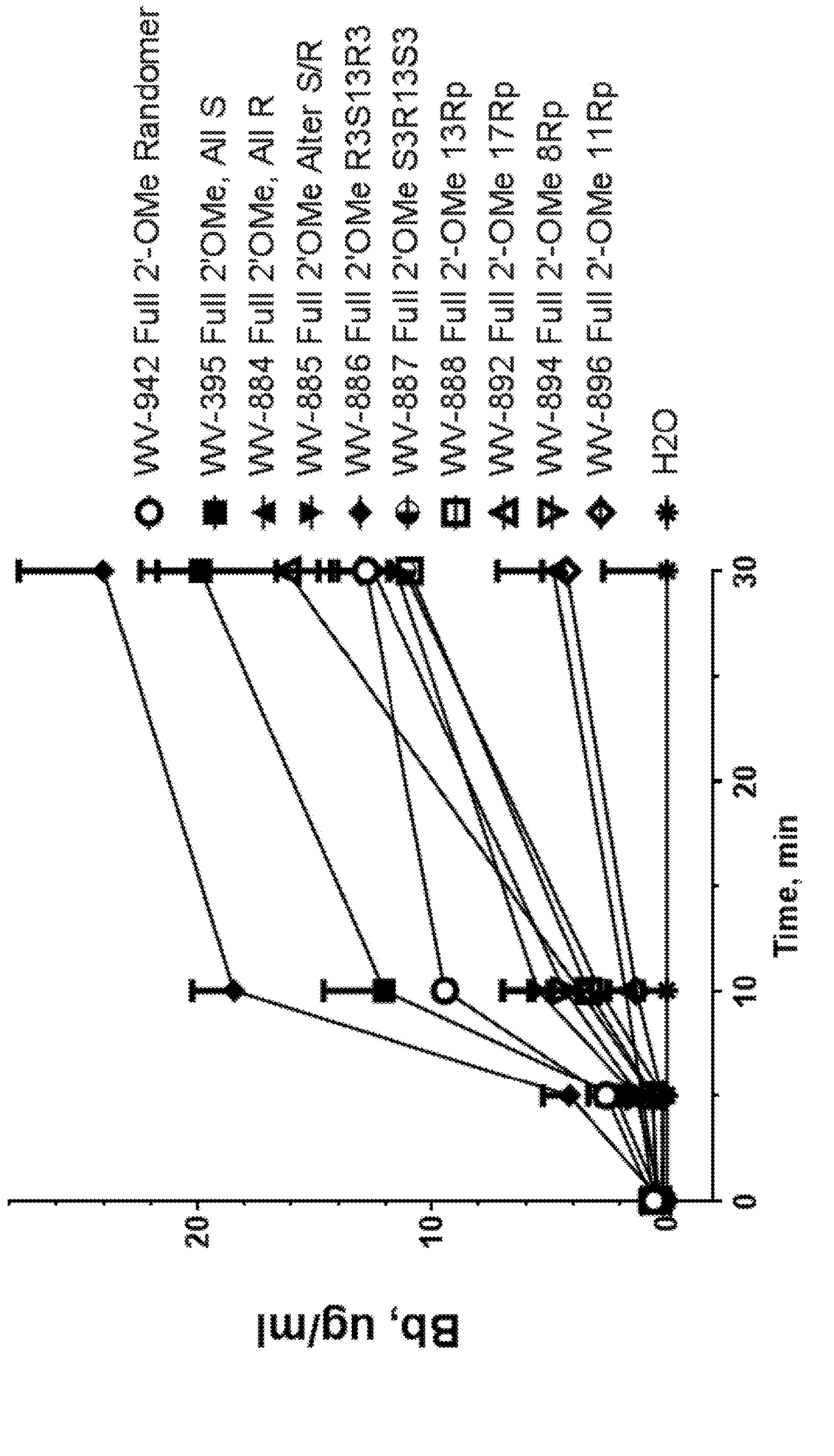
FIG. 5. Example time course of Bb complement activation. Oligonucleotide concentration: 330 μg/mL; 37° C.

Example results were presented in FIGS. 4-5, which demonstrated that provided compositions have significantly lower toxicities compared to the reference composition.

Example 6. Example Protein Binding Assay

Oligonucleotides were diluted in distilled water to 100 µM to make stock solution. Human Serum Albumin (Fatty acid free, Globulin free, Sigma-Aldrich A3782) was diluted with PBST (1×PBS+0.1% Tween) to 5 mg/mL. Oligonucleotides were diluted 100 times into PBST or 5 mg/mL-Albumin solution to make 1 µM working solution. Oligonucleotide-PBST samples provided estimates of efficiency of oligonucleotide recovery after ultrafiltration, and were used to normalize oligonucleotide concentrations in flow-through of Albumin-binding solution. The 1 µM working solutions were incubated at 37° C. for half an hour. 100 µL of protein/1 µM oligonucleotide complex was put into ultrafiltration tubes (Amicon Ultra 50 kDa cut-off, regenerated cellulose) and centrifuged at 9,000×g for 3 min. The flow-through was collected and assayed for presence of oligonucleotides.

To detect single strand oligonucleotides, OliGreen dye was used. The dilution buffer was TE. Each oligonucleotide had its own standard curve made. Oligonucleotide was diluted to 0.5 μM (200× dilution from 100 μM stock), then seven 1:1 serial dilutions were made in duplicate. 20 μL of each diluted oligonucleotide standard was added to UV transparent half-area 96 well plate. All samples of ultrafiltration flow-through, including original 1 μM Oligonucleotide/PBST and 1 μM Oligonucleotide/protein, were 1:1 serial diluted starting at 4 folds of dilution. 20 μl of each sample was added along with its respective standard. Quant-iT OliGreen dye (Life Technologies, 07582) was diluted 200 times to make working solution. 20 μl of OliGreen working solution was mixed with each oligonucleotide samples and incubated at room temperature. The plate was read using fluorescence microplate reader (excitation=480 nm; emission=520 nm).

The concentration of oligonucleotide was calculated according to its own standard curve. Recovery of free oligonucleotide was calculated as $R_{oligo}=C_{P\text{-}FT}/C_{P\text{-}orig}$ ($R_{oligo}$ is the recovery of free oligonucleotide; $C_{P\text{-}FT}$ is concentration of PBST-flowthrough; $C_{P\text{-}orig}$ is concentration of PBST original working stock). Albumin bound oligonucleotide concentration was normalized as $C_{A\text{-}UB}=C_{A\text{-}FT}/R_{oligo}$; ($C_{A\text{-}UB}$ is Albumin unbound oligo concentration normalized; $C_{A\text{-}FT}$ is measured concentration of oligonucleotide in flow-through in Albumin treated sample). Percentage of unbound free oligonucleotide in Albumin samples was calculated as $P_{A\text{-}UB}=100*C_{A\text{-}UB}/C_{A\text{-}orig}$ ($P_{A\text{-}UB}$ is percentage of unbound free oligonucleotide of Albumin samples; $C_{A\text{-}orig}$ is concentration of Albumin original working stock). % Bound=100−$P_{A\text{-}UB}$.

Figure 6:
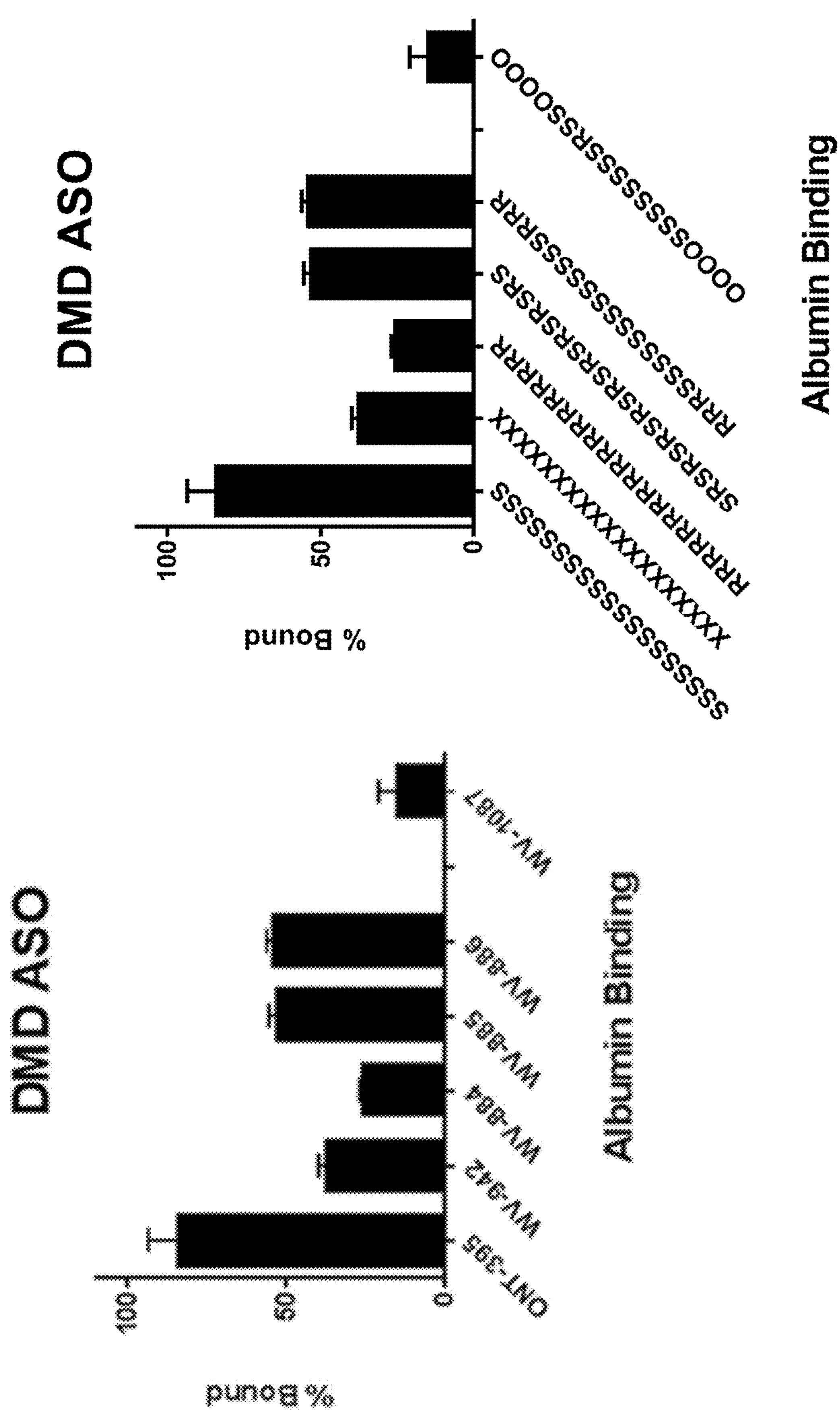
FIG. 6. Example albumin binding.
Figure 6:
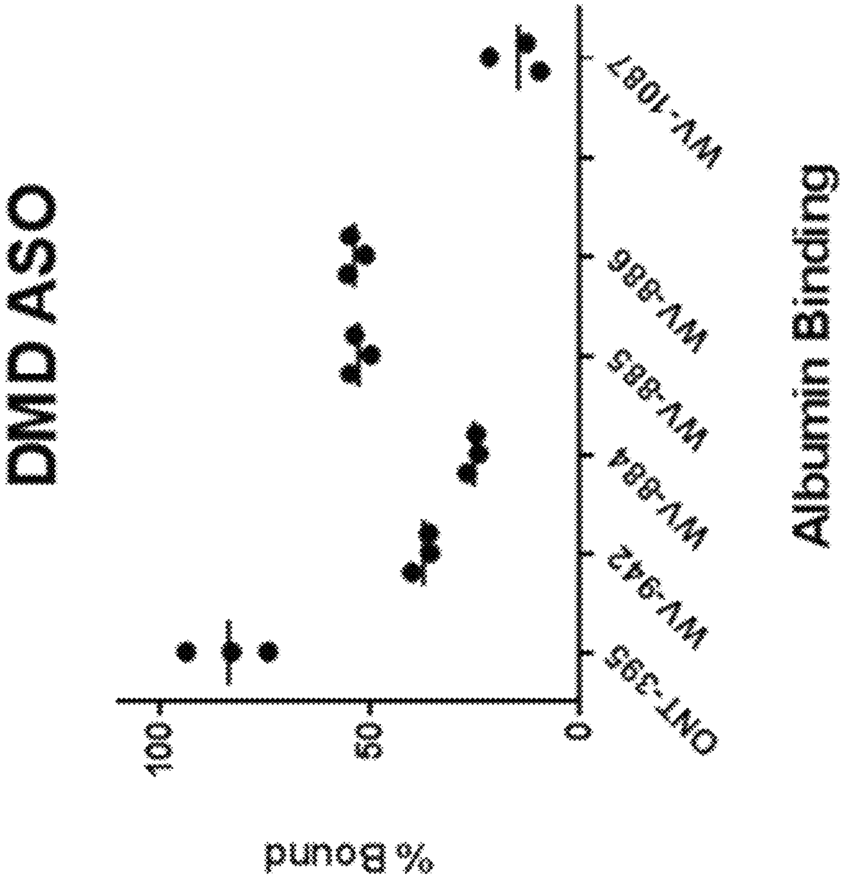
Figure 7B:
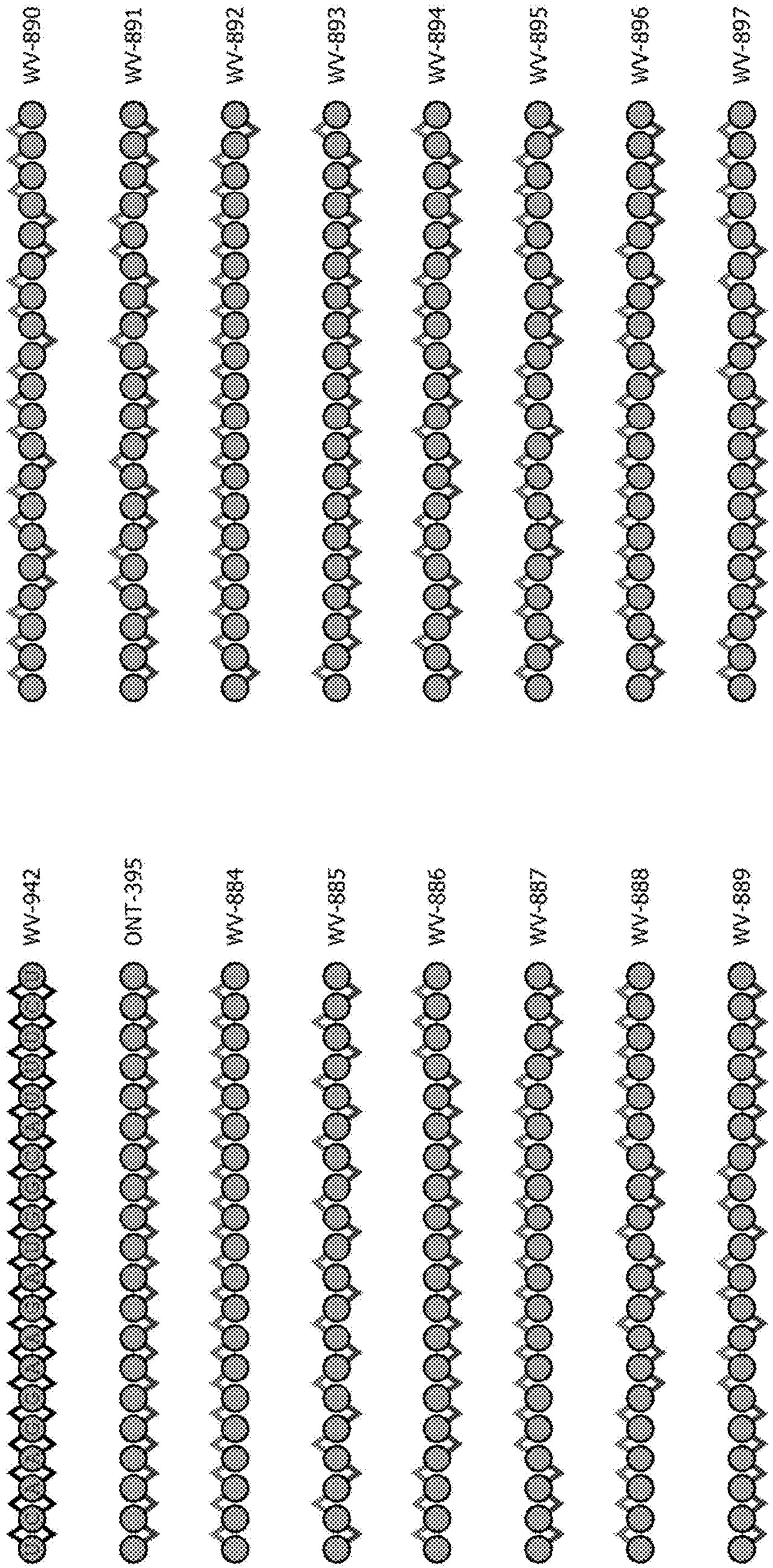
Figure 8A:
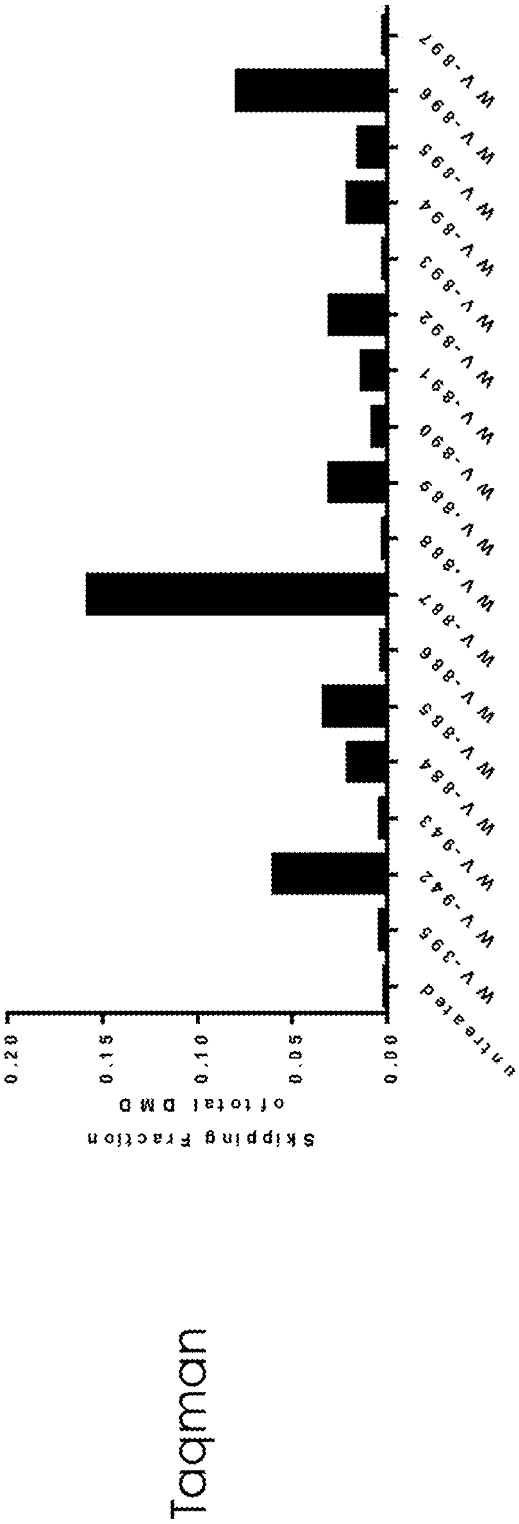
FIGS. 8A and 8B. Ability of various oligonucleotides to induce skipping of exon 51 of human dystrophin. 8B is a compilation of data, including three or more replicates. Controls: WV-942, WV-1714, and untreated; Concentration: 10 uM; Duration: 4 days in differentiation medium; treatment was gymnotic (without transfection reagent); Cells: Del 48-50 [Primary human myoblasts from a patient with (dystrophin deletion exon 48-50), DL 589.2 (dystrophin deletion exon 51-55)].
Figure 8B:
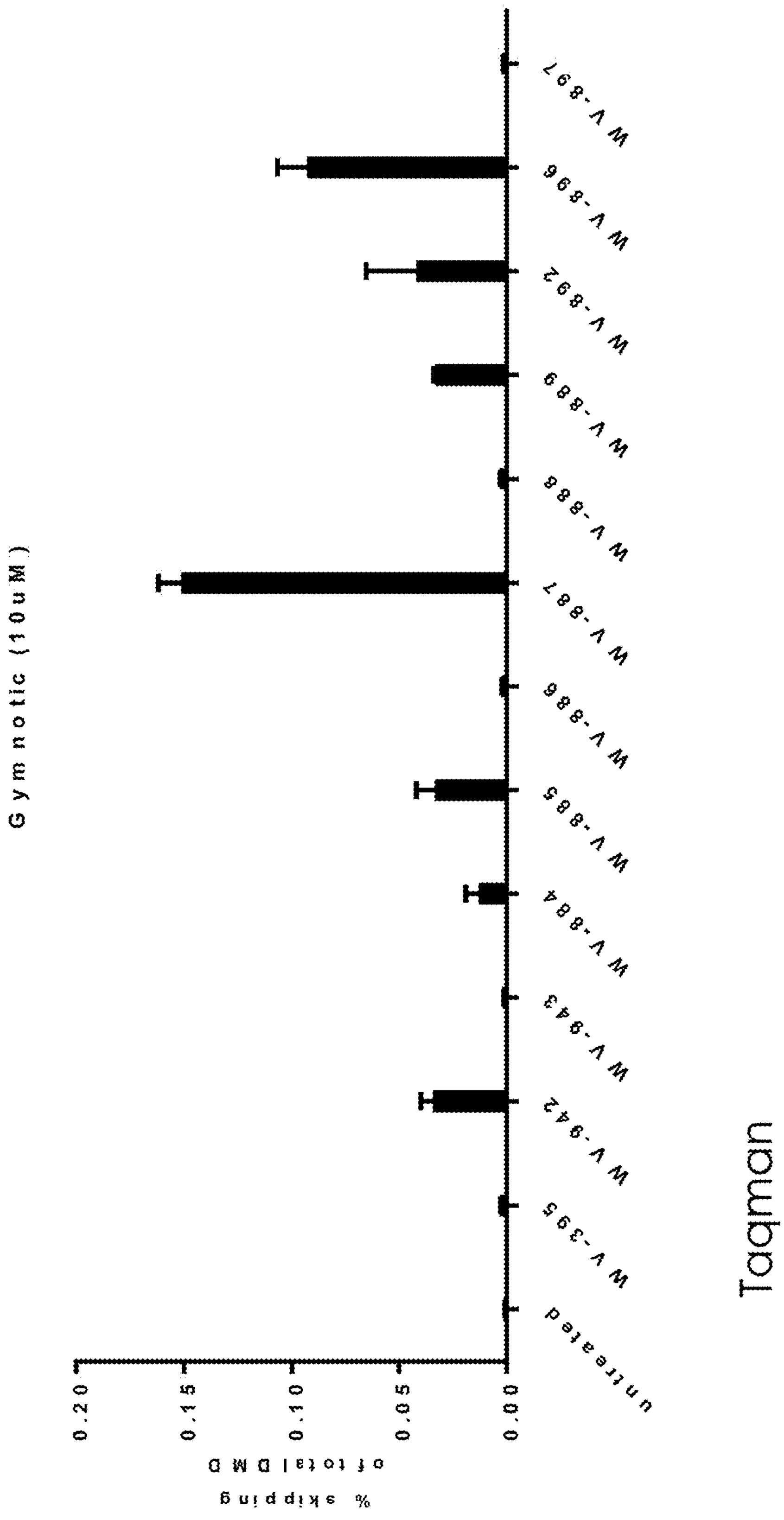
Figure 9B:
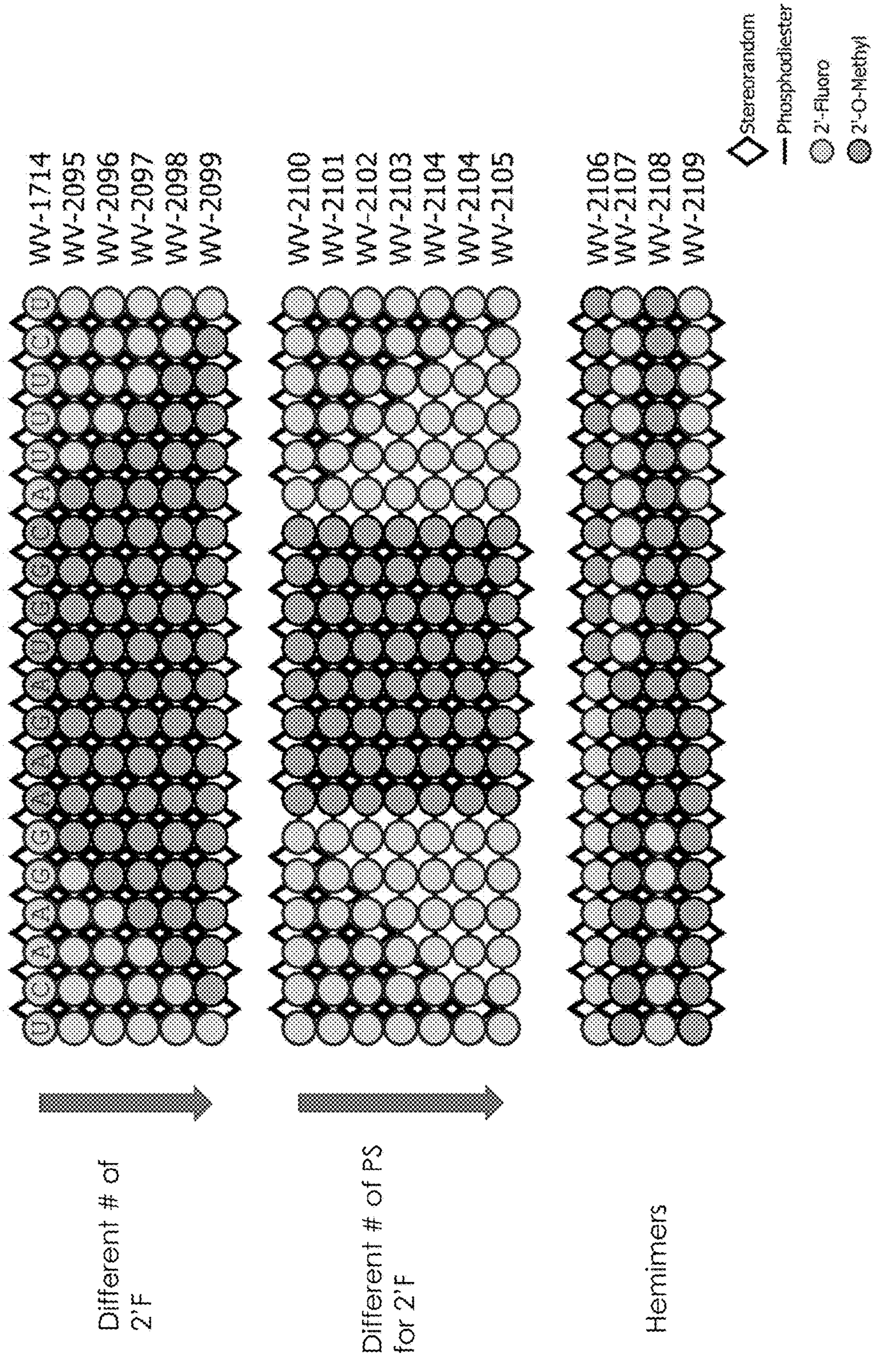
Figure 10A:
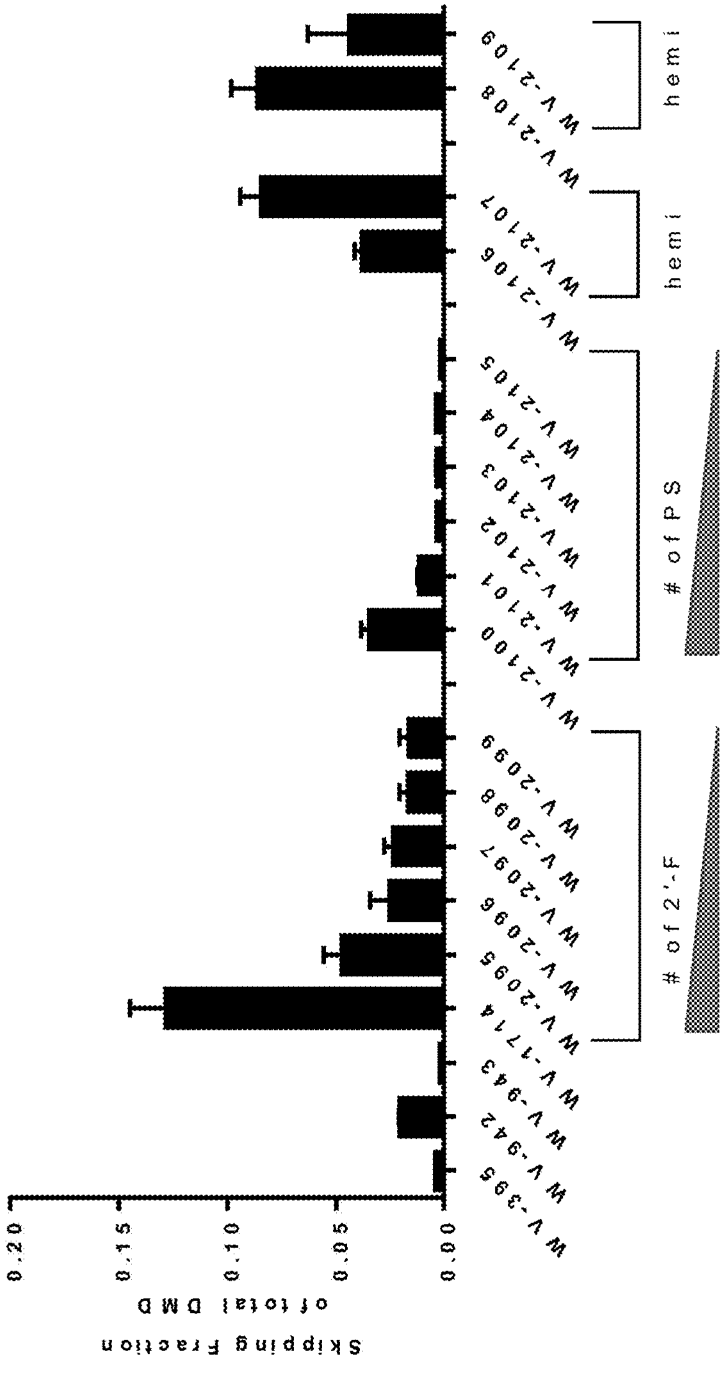
FIGS. 10A and 10B. Ability of various oligonucleotides to induce skipping of exon 51 of dystrophin.
Figure 10B:
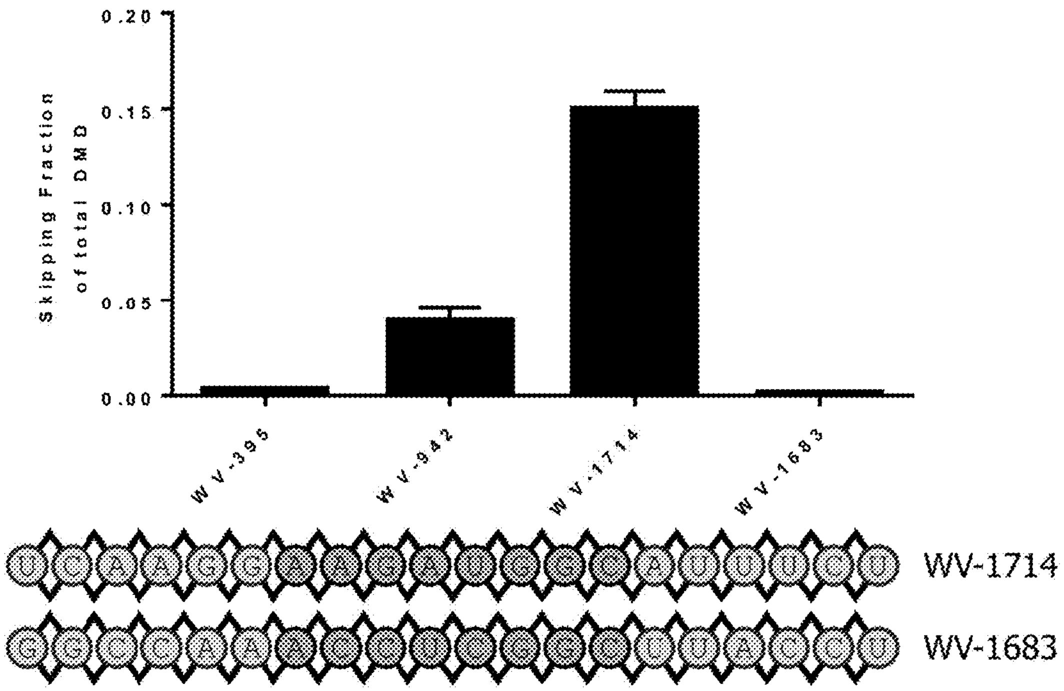
Figure 11B:
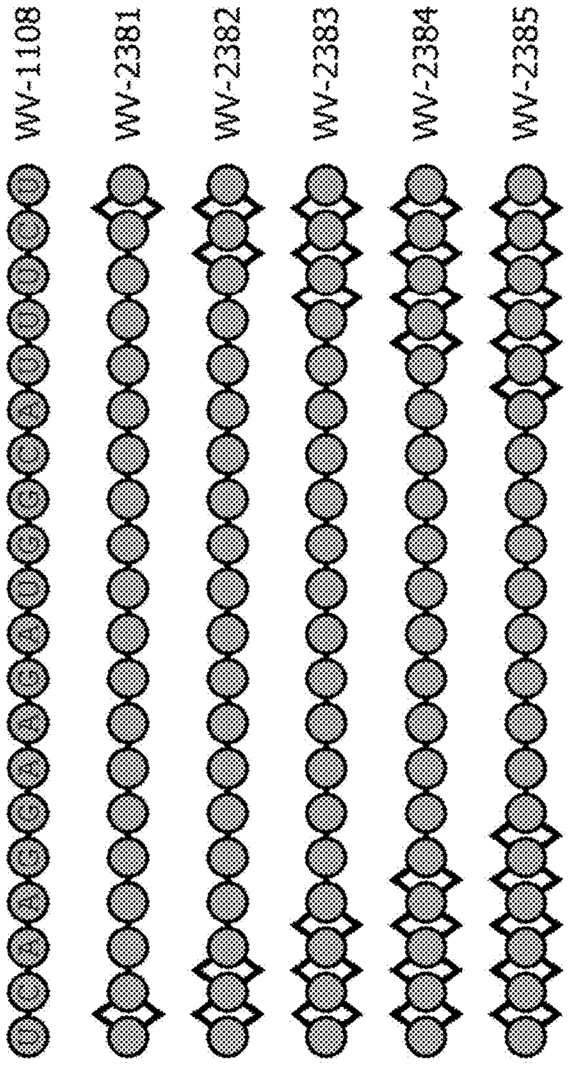
Figure 12:
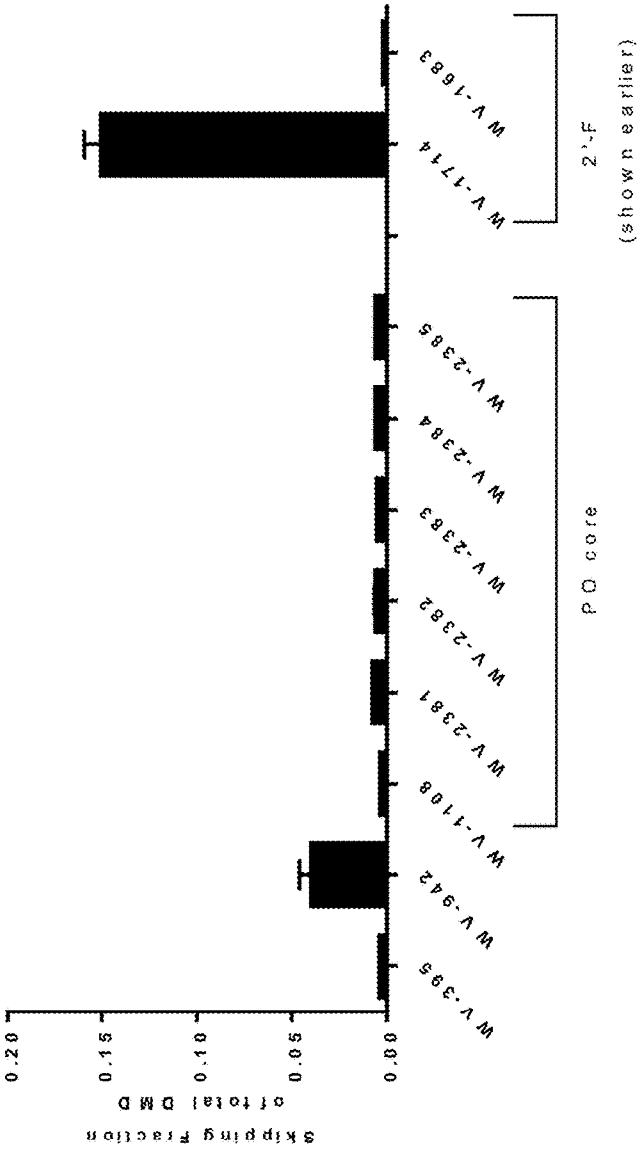
FIG. 12. Ability of various oligonucleotides to induce skipping of exon 51 of dystrophin. Controls: WV-942 (Drisapersen, stereorandom) and untreated; Concentration: 10 uM; Duration: 4 days in differentiation medium; Cells: Del 48-50; treatment was gymnotic (without transfection reagent).
Figure 13B:
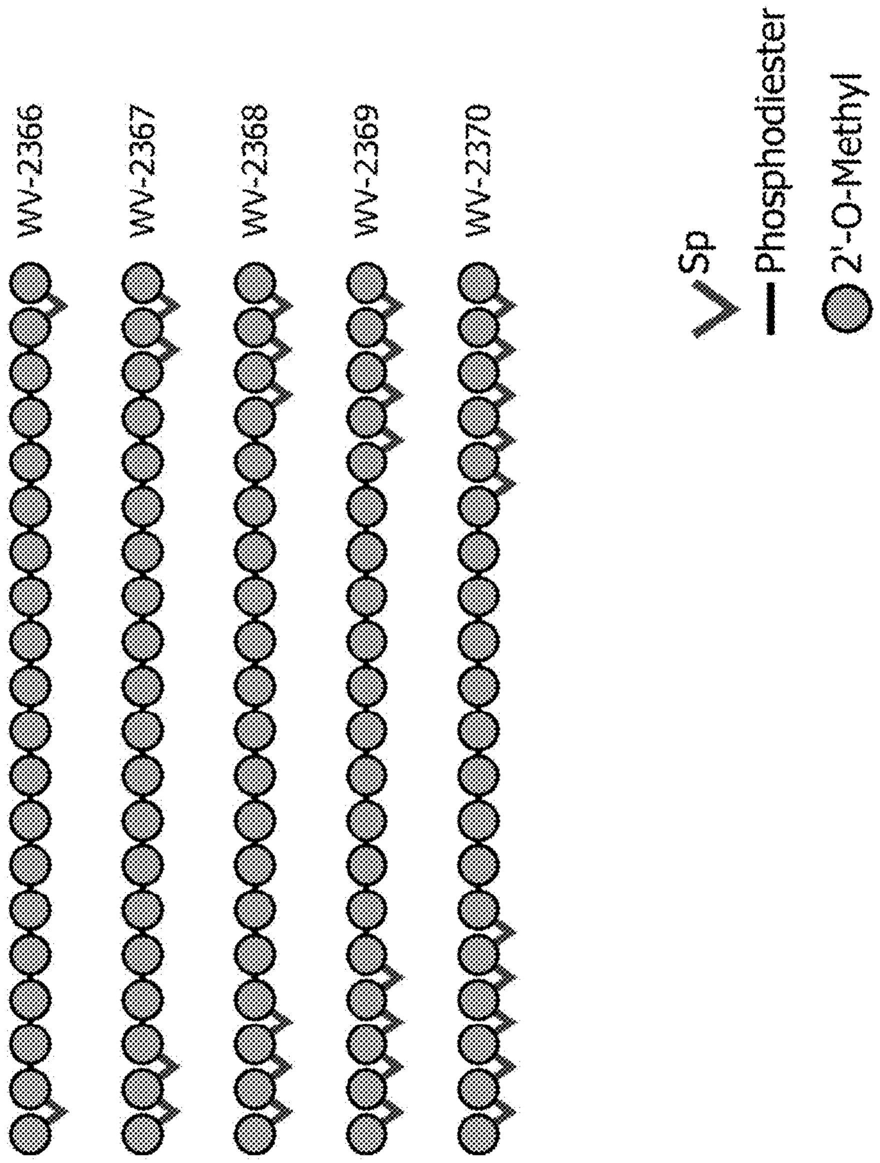

Example results are presented in FIG. 6.

Example 7. Example Assay for Measuring TLR9 Agonist and Antagonist Activities Various assays can be utilized to assay TLR9 activities of provided compositions in accordance with the present disclosure. In one example human TLR9 report assay, HEK-Blue™ TLR9 cells which stably overexpress the human TLR9 gene and an NF-kB inducible secreted embryonic alkaline phosphatase (SEAP) were obtained from Invivogen (San Diego, CA, USA). Oligonucleotides at indicated concentrations were plated into 96-well-plates in the final volume of 20 mL in water. 4×10$^4$ HEK-Blue TLR9 cells were added to each well in a volume of 180 mL in SEAP detection medium. In certain experiments, oligonucleotides were added in the presence or absence of various concentrations of TLR9 agonists (e.g., oligonucleotide ODN2006), and the cultures were continued for 16 h. At the end of the treatment, OD was measured at 655 nM. The results are expressed as fold change in NF-κB activation over phosphate buffered saline (PBS)-treated cells.

Example 8. Example In Vivo Delivery of Provided Oligonucleotides and Compositions Example in vivo oligonucleotide treatment: Five-week-old mdx mice were dosed i.v. or subcutaneously at 5 mL/kg at concentration of 10 mg/mL on Day 1. On Day 4 (or other days as desired), all animals were subjected to both terminal blood and tissue collection. Plasma was aliquoted into polpropylene tubes and stored at −70° C. For tissue collections, all animals were euthanized via $CO_2$ asphyxiation, and perfused using PBS. The following tissues were also collected: liver, kidney, spleen, heart, thoracic diaphragm, gastrocnemius, quadriceps and triceps. Tissues were snap-frozen (in liquid nitrogen) and stored at −70° C.

Example procedure: In vivo biodistribution of the control oligonucleotide WV-942 and oligonucleotides to be tested (e.g., WV-2588, WV-2581, WV-2582, WV-2584, WV-2585, WV-2586, WV-2587, etc.) was tested following a single subcutaneous administration to C57BL/10ScSn-Dmd$^{mdx}$/J male mice 5 weeks of age (Jackson Laboratory, Stock #001801). Animals were housed at 18° C. to 26° C. and 30% to 70% humidity two per cage in polycarbonate cages during acclimation and throughout the study. Housing included Beta Chip® and Enviro-Dri contact bedding. Standard chow and water were supplied ad libitum. The study complied with all applicable sections of the Final Rules of the Animal Welfare Act regulations (Code of Federal Regulations, Title 9), the Public Health Service Policy on Humane Care and Use of Laboratory Animals from the Office of Laboratory Animal Welfare, and the Guide for the Care and Use of Laboratory Animals from the National Research Council. The protocol and any amendments or procedures involving the care or use of animals in this study were reviewed and approved by the Testing Facility Institutional Animal Care and Use Committee before the initiation of such procedures. Below was an example study design (Number of animals (males): 3):

| Group | Test Article | Dose, mg/kg | Dosing Route/ Dosing Day | Test Article Concentration, mg/ml | Dose Volume, ml/kg | Termination Day |
|---|---|---|---|---|---|---|
| 1 | PBS | — | SC, Day 1 | 0 | 5 | Day 3 |
| 2 | WV-942 | 50 | SC, Day 1 | 10 | 5 | Day 3 |
| 3 | WV-2588 | 50 | SC, Day 1 | 10 | 5 | Day 3 |
| 4 | WV-2581 | 50 | SC, Day 1 | 10 | 5 | Day 3 |
| 5 | WV-2582 | 50 | SC, Day 1 | 10 | 5 | Day 3 |
| 6 | WV-2584 | 50 | SC, Day 1 | 10 | 5 | Day 3 |
| 7 | WV-2585 | 50 | SC, Day 1 | 10 | 5 | Day 3 |
| 8 | WV-2586 | 50 | SC, Day 1 | 10 | 5 | Day 3 |
| 9 | WV-2587 | 50 | SC, Day 1 | 10 | 5 | Day 3 |

Animals were euthanized via $CO_2$ asphyxiation 48 hours (+1 hour) after subcutaneous injection on Day 1. All animals were perfused using PBS. The following collected tissues (liver, kidney 2×, spleen, heart, thoracic diaphragm, gastrocnemius, quadriceps, and triceps) were rinsed briefly with PBS, gently blotted dry, snap frozen (liquid $N_2$) in polypropylene tubes and stored at −70° C. until processing for further analysis.

Oligonucleotide quantification: Briefly, each mouse tissue was weighted and lysed in tissue lysis buffer.

Hybridization assay to detect ASO: Sandwich

Methods:

Probe: Capture probe: /5AmMC12/A+GA+AA+TG+CC+A; Detection probe: T+CT+TC+CT+TG+A/3Bio/

Plate: Coat Pierce® Amine-binding, Maleic Anhydride 96-Well Plates, with diluted Capture probe at 500 nM in 2.5% $NaHCO_3$, at 37° C. for at least 1 hour (or 4° C. overnight). After wash with PBST (1×PBS+0.1% Tween-20), block in 5% fat-free milk/PBST at 37° C. for >1 hour.

Tissue sample preparation: Weigh tissue pieces, add 4 volumes of lysis buffer to tissue to achieve 0.2 g tissue/mL, in tissue lysis buffer (IGEPAL 0.5%, 100 mM NaCl, 5 mM EDTA, 10 mM Tris pH8, protease K 300 μg/mL). The homogenate was generated by Bullet Blender (NextAdvance).

Standard Curve: Dilute Test Article into non-treated blank tissue homogenates (matrix) at 10-50 μg/mL (50-250 μg/g tissue). The standard was further serial diluted 1:1 with matrix for 8 points to form standard curve series.

Hybrid-ELISA: Dilute Standard Curve samples, treated tissue homogenates 100-500 times with hybridization buffer (4 M Guanidine; 0.33% N-Lauryl Sarcosine; 25 mM Sodium Citrate; 10 mM DTT). 20 μL of diluted tissue samples were mixed with 180 μL of detection probe diluted in PBST at 333 nM. Samples were denatured using following condition: 65° C., 10 min; 95° C., 15 min; 4° C., ∞. Add 50 μL/well denatured samples into coated 96 wells. Incubate at 4° C. for overnight. Wash plate 3 times with PBST. Add 1:2000 dilution of streptavidin-AP in PBST. Incubate at room temperature for 1 hour. Wash plate 5 times×2 cycles with PBST on Molecular Device plate wash machine. Add 100 μL/well AttoPhos substrates. Incubate for 10 min, read plate at Molecular Device M5 in fluorescence channel: Ex435 nm, Em555 nm. Take another read at 20 min. Oligonucleotide concentration is calculated against Standard Curve by using either linear curve fit or 4-parameter curve fit.

Example test results were presented in the Figures, demonstrating that provided oligonucleotides have improved properties (e.g., distribution, metabolism, etc.).

Example 9. Example Synthesis of Turbinaric Acid

Many types of acids, e.g., fatty acids, are widely known in the art and can be utilized in accordance with the present disclosure to incorporate various types of modifications. A person of ordinary skill in the art appreciates that various lipids, .e.g., fatty acids, are commercially available, and/or can be prepared using widely known and practiced technologies (e.g., reagents, methods, etc.), including those illustrated in the present disclosure. The present example describes preparation of turbinaric acid.

Synthesis of Turbinaric Acid: (4E,8E,12E,16E)-4,8,13,17,21-pentamethyldocosa-4,8,12,16,20-pentaenoic acid. Turbinaric acid has been previously described in, for example, Asari et al. 1989 J. Nat. Prod. 52: 1167-1169.

2-Hydroxy-3-bromosqualene. To a solution of squalene (30.03 g, 73.1 mmol) in THE (210 mL), water (35 mL) was added and then a small amount of THF was added dropwise to obtain a clear solution under Argon. N-bromosuccinimide (15.62 g, 88 mmol) was added portion-wise at 0° C. and the reaction mixture was stirred at 0° C. for 30 minutes and at room temperature for 3 hrs. The solvent was removed under reduced pressure, and brine (500 mL) was added and extracted with EtOA (100 mL×5). The organic layer was dried over anhydrous sodium sulfate and concentrated to give a residue, which was purified by ISCO (220 g gold silica gel cartridge) eluting with hexane to 50% EtOAc in hexane (product was come out at 10-20% EtOAc in hexane) to give 2-hydroxy-3-bromosqualene (9.92 g, 19.54 mmol, 26.7% yield) as a pale yellowish oil. $^1$H NMR (400 MHz, Chloroform-d) δ 5.24-5.05 (m, 5H), 3.98 (dd, J=11.3, 1.9 Hz, 1H), 2.35-2.32 (m, 1H), 2.16-1.90 (m, 18H), 1.85-1.70 (m, 1H), 1.67 (d, J=1.4 Hz, 3H), 1.60 (bs, 15H), 1.34 (s, 3H), 1.32 (s, 3H). MS (ESI), 551.1 and 553.3 $(M+HCOO)^-$.

2,2-Dimethyl-3-((3E,7E,11E,15E)-3,7,12,16,20-pentamethylhenicosa-3,7,11,15,19-pentaen-1-yl)oxirane. To a solution of 2-hydroxy-3-bromosqualene (9.72 g, 19.15 mmol) in MeOH (360 mL), $K_2CO_3$ (5.29 g, 38.3 mmol) was added and the reaction mixture was stirred at room temperature for 2 hrs, filtered and then concentrated under reduced pressure. Then 300 mL EtOAc was added, and filtered, concentrated to give 2,3-oxidosqualene (8.38 g, 19.64 mmol, 100% yield) a colorless oil. $^1$H NMR (400 MHz, Chloroform-d) δ 5.20-5.04 (m, 5H), 2.70 (t, J=7.0 Hz, 1H), 2.20-1.95 (m, 20H), 1.67 (s, 3H), 1.61 (s, 3H), 1.59 (bs, 15H), 1.29 (s, 3H), 1.25 (s, 3H).

(4E,8E,12E,16E)-4,8,13,17,21-pentamethyldocosa-4,8,12,16,20-pentaenal. To a solution of periodic acid (7.79 g, 34.2 mmol) in water (28 mL) at 0° C., a solution of 2,3-oxidosqualene (8.10 g, 18.98 mmol) in dioxane (65 mL)

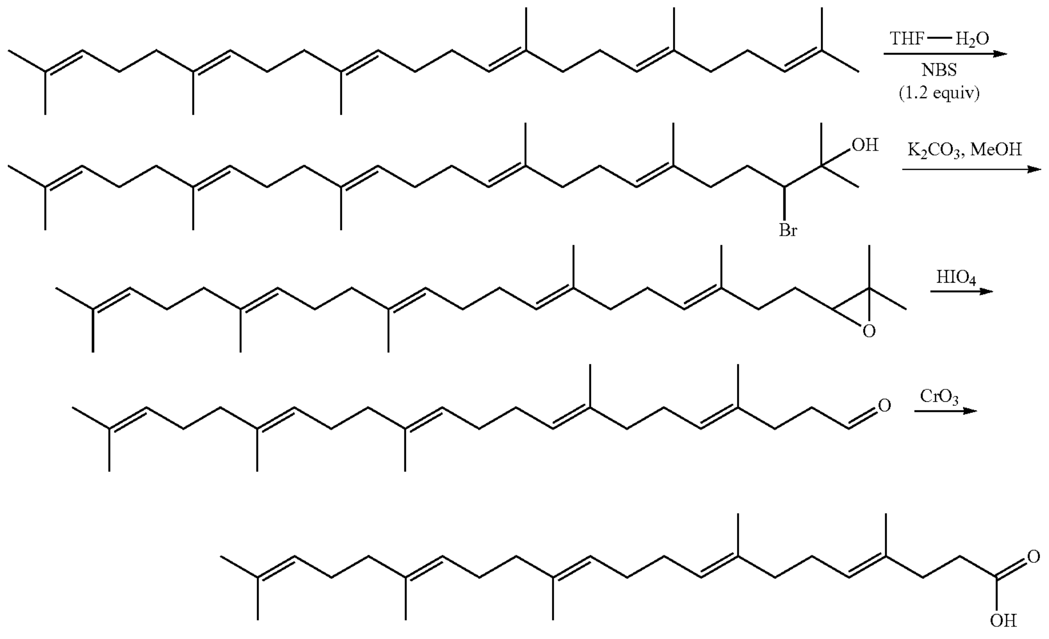

was added. The reaction mixture was stirred at room temperature for 2 hrs. Water (150 mL) was added and extracted with EtOAc (3×100 mL). The organic layer are dried over anhydrous sodium sulfate and concentrated under reduced pressure to give a residue, which was purified by ISCO (120 g gold silica gel cartridge) eluting with hexane to 10% EtOAc in hexane (product come out at 5-7% EtOAc in hexane to give (4E,8E,12E,16E)-4,8,13,17,21-pentamethyldocosa-4,8,12,16,20-pentaenal (5.80 g, 15.08 mmol, 79% yield) as a colorless oil. $^1$H NMR (400 MHz, Chloroform-d) δ 9.74 (t, J=2.0 Hz, 1H), 5.18-5.04 (m, 5H), 2.50 (td, J=7.5, 2.0 Hz, 2H), 2.31 (t, J=7.5 Hz, 2H), 2.13-1.92 (m, 16H), 1.67 (s, 3H), 1.61 (s, 3H), 1.59 (bs, 12H).

Turbinaric Acid. Sulfuric acid (8.2 mL) followed by sodium dichromate dihydrate (4.42 g, 14.82 mmol) was added to HPLC water (80 mL) at 0° C. The above chromic acid solution was added dropwise to a solution of (4Z,8Z,12E,16E)-4,8,13,17,21-pentamethyldocosa-4,8,12,16,20-pentaenal (5.70 g, 14.82 mmol) in ethyl ether (115 mL) at 0° C. The reaction mixture was stirred at 0° C. for 2 hrs. After 2 hrs, TLC showed the reaction was complete (3:1 hexane/EtOAc). The reaction mixture was diluted with EtOAc (300 mL), washed with brine (100 mL×4), dried over anhydrous, concentrated to give a residue, which was purified by ISCO (80 g silica gel cartridge) eluting with DCM to 5% MeOH in DCM to give turbinaric acid as a colorless oil (5.00 g, 84% yield). $^1$H NMR (400 MHz, Chloroform-d) δ 5.18-5.07 (m, 5H), 2.44 (t, J=6.5 Hz, 2H), 2.30 (t, J=7.7 Hz, 2H), 2.13-1.93 (m, 16H), 1.67 (s, 3H), 1.59 (bs, 15H); MS (ESI), 399.3 $(M-H)^-$.

Example 10. Example Synthesis of 1,7,14-trioxo-12,12-bis((3-oxo-3-((3-(4-sulfamoylbenzamido)propyl)amino)propoxy)methyl)-1-(4-sulfamoylphenyl)-10-oxa-2,6,13-triazaoctadecan-18-oic acid

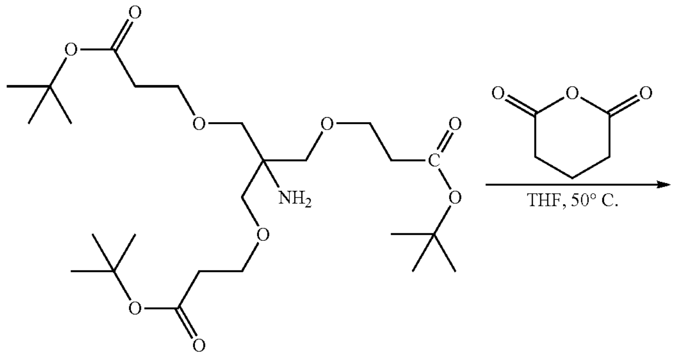

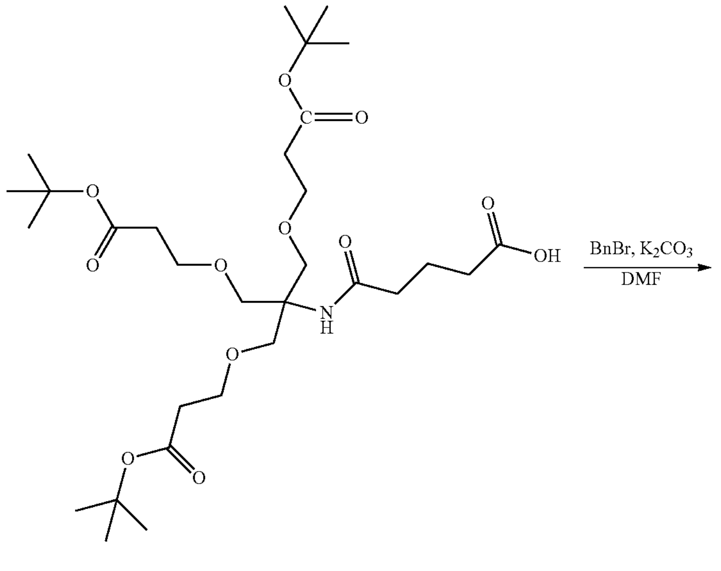

-continued
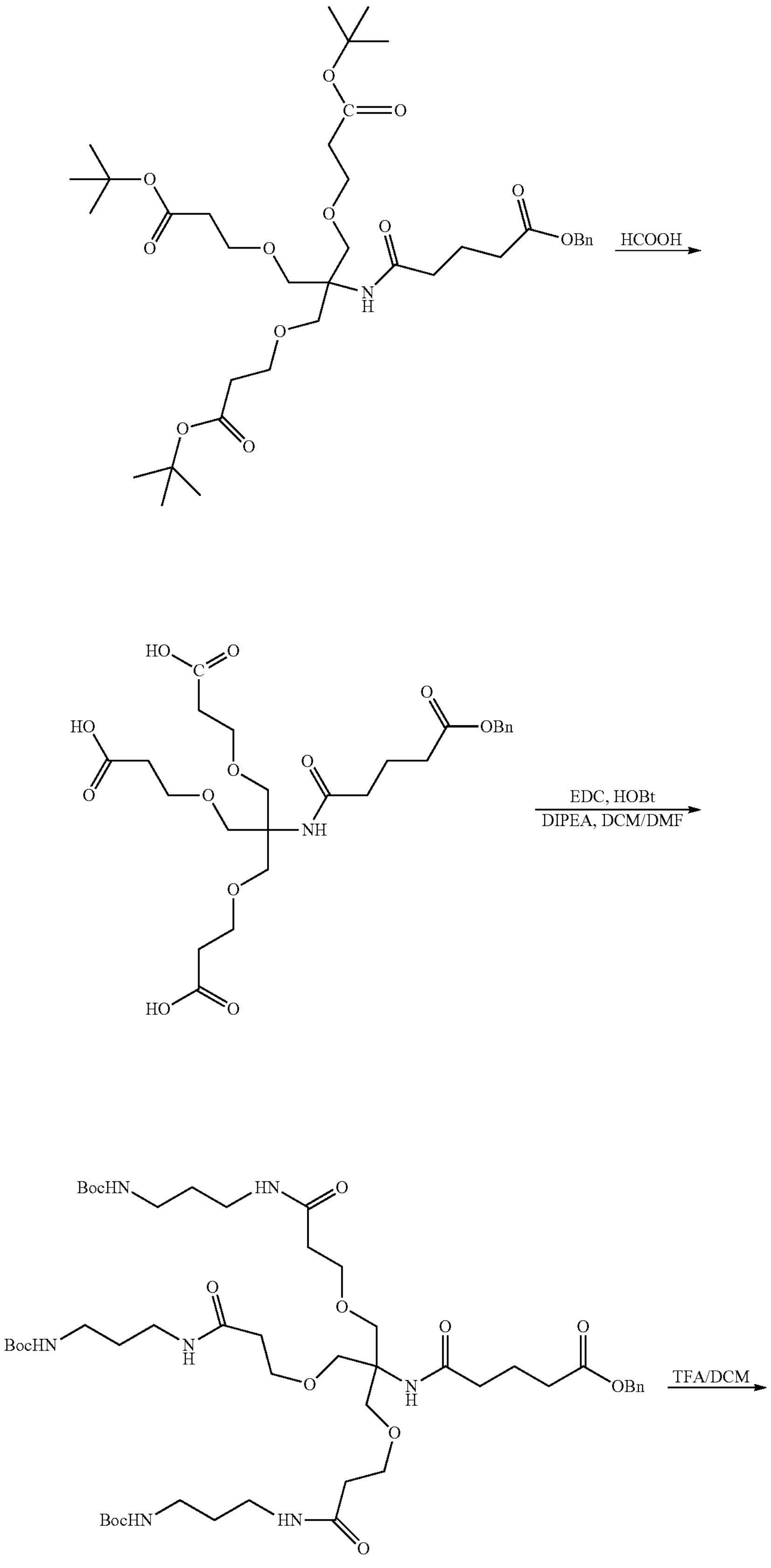

-continued

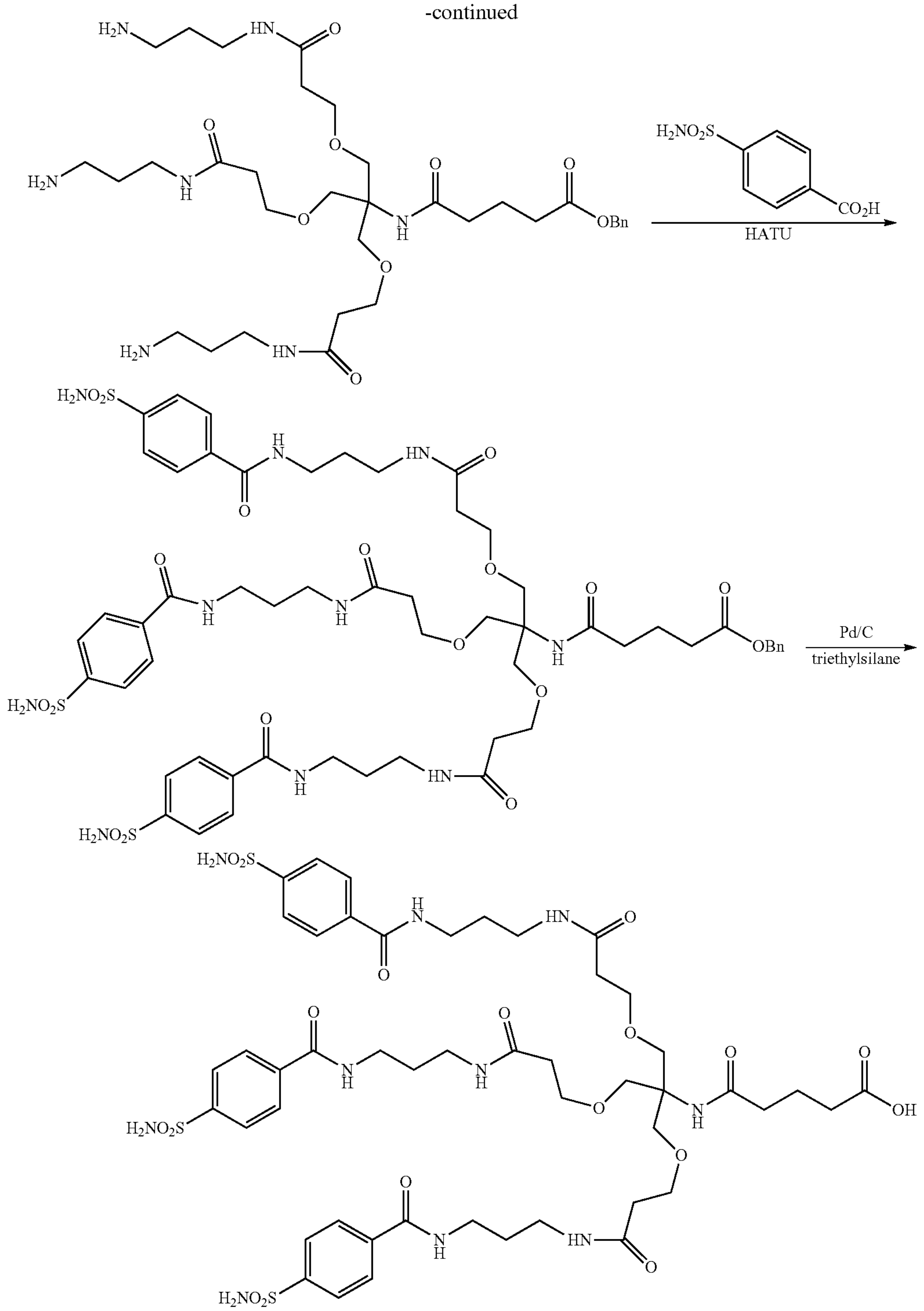

Step 1: A solution of di-tert-butyl 3,3'-((2-amino-2-((3-(tert-butoxy)-3-oxopropoxy)methyl)propane-1,3-diyl)bis(oxy))dipropanoate (4.0 g, 7.91 mmol) and dihydro-2H-pyran-2,6(3H)-dione (0.903 g, 7.91 mmol) in THE (40 mL) was stirred at 50° C. for 3 hrs and at rt for 3 hrs. LC-MS showed desired product. Solvent was evaporated to give 5-((9-((3-(tert-butoxy)-3-oxopropoxy)methyl)-2,2,16,16-tetramethyl-4,14-dioxo-3,7,11,15-tetraoxaheptadecan-9-yl)amino)-5-oxopentanoic acid, which was directly used for next step without purification.

Step 2: To a solution of 5-((9-((3-(tert-butoxy)-3-oxopropoxy)methyl)-2,2,16,16-tetramethyl-4,14-dioxo-3,7,11,15-tetraoxaheptadecan-9-yl)amino)-5-oxopentanoic acid (4.90 g, 7.91 mmol) and (bromomethyl)benzene (1.623 g, 9.49 mmol) in DMF was added anhydrous $K_2CO_3$ (3.27 g, 23.73 mmol). The mixture was stirred at 40° C. for 4 hrs and at room temperature for overnight. Solvent was evaporated under reduced pressure. The reaction mixture was diluted with EtOAc, washed with water, dried over anhydrous sodium sulfate, and concentrated under reduced pressure to give a residue, which was purified by ISCO eluting with 10% EtOAc in hexane to 50% EtOAc in hexane to give di-tert-butyl 3,3'-((2-(5-(benzyloxy)-5-oxopentanamido)-2-((3-(tert-butoxy)-3-oxopropoxy)methyl)propane-1,3-diyl) bis(oxy))dipropanoate (5.43 g, 7.65 mmol, 97% yield) as a colorless oil. $^1$H NMR (400 MHz, Chloroform-d) δ 7.41-7.28 (m, 5H), 6.10 (s, 1H), 5.12 (s, 2H), 3.72-3.60 (m, 12H), 2.50-2.38 (m, 8H), 2.22 (t, J=7.3 Hz, 2H), 1.95 (p, J=7.4 Hz, 2H), 1.45 (s, 27H); MS (ESI), 710.5 (M+H)$^+$.

Step 3: A solution of di-tert-butyl 3,3'-((2-(5-(benzyloxy)-5-oxopentanamido)-2-((3-(tert-butoxy)-3-oxopropoxy) methyl)propane-1,3-diyl)bis(oxy))dipropanoate (5.43 g, 7.65 mmol) in formic acid (50 mL) was stirred at room temperature for 48 hrs. LC-MS showed the reaction was not complete. Solvent was evaporated under reduced pressure. The crude product was re-dissolved in formic acid (50 mL) and was stirred at room temperature for 6 hrs. LC-MS showed the reaction was complete. Solvent was evaporated under reduced pressure, co-evaporated with toluene (3×) under reduced pressure, and dried under vacuum to give 3,3'-((2-(5-(benzyloxy)-5-oxopentanamido)-2-((2-carboxyethoxy)methyl)propane-1,3-diyl)bis(oxy))dipropanoic acid (4.22 g, 7.79 mmol, 100% yield) as a white solid. $^1$H NMR (500 MHz, DMSO-$d_6$) δ 12.11 (s, 3H), 7.41-7.27 (m, 5H), 6.97 (s, 1H), 5.07 (s, 2H), 3.55 (d, J=6.4 Hz, 6H), 2.40 (t, J=6.3 Hz, 6H), 2.37-2.26 (m, 2H), 2.08 (t, J=7.3 Hz, 2H), 1.70 (p, J=7.4 Hz, 2H); MS (ESI), 542.3 (M+H)$^+$.

Step 4: To a solution of 3,3'-((2-(5-(benzyloxy)-5-oxopentanamido)-2-((2-carboxyethoxy)methyl)propane-1,3-diyl)bis(oxy))dipropanoic acid (4.10 g, 7.57 mmol) and HOBt (4.60 g, 34.1 mmol) in DCM (60 mL) and DMF (15 mL) at 0° C. was added tert-butyl (3-aminopropyl)carbamate (5.94 g, 34.1 mmol), EDAC HCl salt (6.53 g, 34.1 mmol) and DIPEA (10.55 mL, 60.6 mmol). The reaction mixture was stirred at 0° C. for 15 minutes and at room temperature for 20 hrs. LC-MS showed the reaction was not complete. EDAC HCl salt (2.0 g) and tert-butyl (3-aminopropyl) carbamate (1.0 g) was added into the reaction mixture. The reaction mixture was stirred at room temperature for 4 hrs. Solvent was evaporated to give a residue, which was dissolved in EtOAc (300 mL), washed with water (1×), saturated sodium bicarbonate (2×), 10% citric acid (2×) and water, dried over sodium sulfate, and concentrated to give a residue which was purified by ISCO (80 g gold cartridge) eluting with DCM to 30% MeOH in DCM to give benzyl 15,15-bis(13,13-dimethyl-5,11-dioxo-2,12-dioxa-6,10-diazatetradecyl)-2,2-dimethyl-4,10,17-trioxo-3,13-dioxa-5,9,16-triazahenicosan-21-oate 5 (6.99 g, 6.92 mmol, 91% yield) as a white solid. $^1$H NMR (500 MHz, Chloroform-d) δ 7.35 (t, J=4.7 Hz, 5H), 6.89 (s, 3H), 6.44 (s, 1H), 5.22 (d, J=6.6 Hz, 3H), 5.12 (s, 2H), 3.71-3.62 (m, 12H), 3.29 (q, J=6.2 Hz, 6H), 3.14 (q, J=6.5 Hz, 6H), 2.43 (dt, J=27.0, 6.7 Hz, 8H), 2.24 (t, J=7.2 Hz, 2H), 1.96 (p, J=7.5 Hz, 2H), 1.69-1.59 (m, 6H), 1.43 (d, J=5.8 Hz, 27H); MS (ESI): 1011.5 (M+H)+.

Step 5: To a solution of benzyl 15,15-bis(13,13-dimethyl-5,11-dioxo-2,12-dioxa-6,10-diazatetradecyl)-2,2-dimethyl-4,10,17-trioxo-3,13-dioxa-5,9,16-triazahenicosan-21-oate (1.84 g, 1.821 mmol) in DCM (40 mL) was added 2,2,2-trifluoroacetic acid (7.02 mL, 91 mmol). The reaction mixture was stirred at room temperature for overnight. Solvent was evaporated to give benzyl 5-((1,19-diamino-10-((3-((3-aminopropyl)amino)-3-oxopropoxy)methyl)-5,15-dioxo-8,12-dioxa-4,16-diazanonadecan-10-yl)amino)-5-oxopentanoate as a colorless oil. MS (ESI), 710.6 (M+H)$^+$.

Step 6: To a solution of 4-sulfamoylbenzoic acid (1.466 g, 7.28 mmol) in DCM (40 mL) was added HATU (2.77 g, 7.28 mmol) followed by benzyl 5-((1,19-diamino-10-((3-((3-aminopropyl)amino)-3-oxopropoxy)methyl)-5,15-dioxo-8,12-dioxa-4,16-diazanonadecan-10-yl)amino)-5-oxopentanoate (1.293 g, 1.821 mmol) in DMF (4.0 mL). The mixture was stirred at room temperature for 5 hrs. Solvent was evaporated under reduced pressure to give a residue, which was purified by ISCO (40 g gold column) eluting with DCM to 50% MeOH in DCM to give benzyl 1,7,14-trioxo-12,12-bis((3-oxo-3-((3-(4-sulfamoylbenzamido)propyl) amino)-propoxy)methyl)-1-(4-sulfamoylphenyl)-10-oxa-2,6,13-triazaoctadecan-18-oate (0.36 g, 0.286 mmol, 16% yield). $^1$H NMR (400 MHz, DMSO-$d_6$) δ 8.60 (t, J=5.6 Hz, 3H), 7.96-7.81 (m, 15H), 7.44 (s, 6H), 7.35-7.23 (m, 5H), 7.04 (s, 1H), 5.02 (s, 2H), 3.50 (t, J=6.9 Hz, 6H), 3.48 (s, 6H), 3.23 (q, J=6.6 Hz, 6H), 3.06 (q, J=6.6 Hz, 6H), 2.29 (t, J=7.4 Hz, 2H), 2.24 (t, J=6.5 Hz, 6H), 2.06 (t, J=7.4 Hz, 2H), 1.69-1.57 (m, 8H).

Step 7: To a round bottom flask flushed with Ar was added 10% Pd/C (80 mg, 0.286 mmol) and EtOAc (15 mL). A solution of benzyl 1,7,14-trioxo-12,12-bis((3-oxo-3-((3-(4-sulfamoylbenzamido)propyl)amino)propoxy)methyl)-1-(4-sulfamoylphenyl)-10-oxa-2,6,13-triazaoctadecan-18-oate (360 mg) in methanol (15 mL) was added followed by diethyl(methyl)silane (0.585 g, 5.72 mmol) dropwise. The mixture was stirred at room temperature for 3 hrs. LC-MS showed the reaction was complete. The reaction was diluted with EtOAc, and filtered through celite, washed with 20% MeOH in EtOAc, and concentrated under reduced pressure to give 1,7,14-trioxo-12,12-bis((3-oxo-3-((3-(4-sulfamoylbenzamido)propyl)-amino)propoxy)methyl)-1-(4-sulfamoylphenyl)-10-oxa-2,6,13-triazaoctadecan-18-oic acid (360 mg, 100% yield) as a white solid. $^1$H NMR (400 MHz, DMSO-$d_6$) δ 8.60 (t, J=5.6 Hz, 3H), 7.94-7.81 (m, 15H), 7.44 (s, 6H), 7.04 (s, 1H), 3.50 (t, J=6.9 Hz, 6H), 3.48 (s, 6H), 3.23 (q, J=6.6 Hz, 6H), 3.06 (q, J=6.6 Hz, 6H), 2.24 (t, J=6.4 Hz, 6H), 2.14 (t, J=7.5 Hz, 2H), 2.05 (t, J=7.4 Hz, 2H), 1.66-1.57 (m, 8H); MS (ESI), 1170.4 (M+H)$^+$.

Example 11. Example Synthesis of 2-cyanoethyl ((6Z,9Z,28Z,31Z)-heptatriaconta-6,9,28,31-tetraen-19-yl) diisopropylphosphoramidite and Amidite from Lauryl Alcohol As appreciated by a person having ordinary skill in the art, various alcohols can be converted into phosphoramidites and conjugated to oligonucleotide chains using known technologies in the art in accordance with the present disclosure. The present example illustrates preparation of 2-cyanoethyl ((6Z,9Z,28Z,31Z)-heptatriaconta-6,9,28,31-tetraen-19-yl) diisopropylphosphoramidite, which can be used to, e.g., prepare oligonucleotides comprising Mod021.

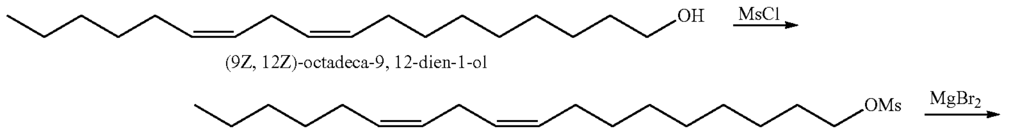

(9Z, 12Z)-octadeca-9, 12-dien-1-ol

-continued

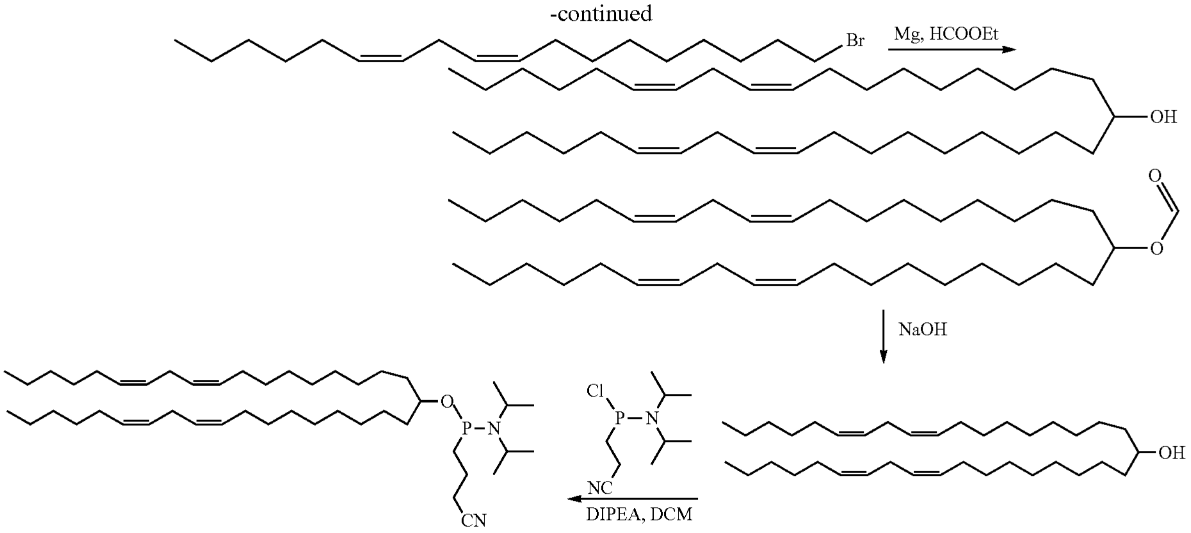

Synthesis of (9Z,12Z)-octadeca-9,12-dien-1-yl methanesulfonate (or linoleyl methanesulfonate). To a solution of linoleyl alcohol (23.31 mL, 75 mmol) and triethylamine (13.60 mL, 98 mmol) in DCM (150 mL) at 0° C. was added methanesulfonyl chloride (6.39 mL, 83 mmol) dropwise. The reaction mixture was stirred at 0° C. for 30 minutes and at room temperature for 3 hrs. The reaction mixture was diluted with DCM (200 mL), washed with water, sat sodium bicarbonate and brine and dried over anhydrous sodium sulfate. Solvent was concentrated to give linoleyl methanesulfonate (26.17 g, 100% yield) as an yellowish oil. Without further purification, the product was directly used for next step. $^1$H NMR (500 MHz, Chloroform-d) δ 5.30-5.41 (m, 4H), 4.22 (t, J=6.6 Hz, 2H), 2.99 (s, 3H), 2.77 (t, J=6.7 Hz, 2H), 2.05 (q, J=6.9 Hz, 4H), 1.74 (p, J=6.7 Hz, 2H), 1.43-1.25 (m, 16H), 0.89 (t, J=6.7 Hz, 3H).

Synthesis of linoleyl bromide. To a solution of linoleyl methanesulfonate (26 g, 75 mmol) in ether (800 mL) was added magnesium bromide ethyl etherate (58.5 g, 226 mmol) under Argon. The reaction mixture was stirred at room temperature for 2 hrs. TLC was used to monitor reaction progress. If not completed, additional magnesium bromide ethyl etherate (14.5 g) was added the reaction mixture and the reaction mixture was stirred at room temperature for 22 hrs. TLC showed the reaction was complete (9/1 hexane/EtOAc). The reaction mixture was filtered, washed with ether (200 mL), hexane (100 mL), and concentrated under reduced pressure to give a residue, which was purified by ISCO (200 g gold silica gel cartridge) eluted with hexane to 10% EtOAc in hexane to give linoleyl bromide (22.8 g, 69.2 mmol, 92% yield) as a colorless oil. $^1$H NMR (500 MHz, Chloroform-d) δ 5.42-5.31 (m, 4H), 3.41 (t, J=6.9 Hz, 2H), 2.77 (t, J=6.6 Hz, 2H), 2.05 (q, J=6.9 Hz, 4H), 1.85 (p, J=6.9 Hz, 2H), 1.43-1.25 (m, 16H), 0.89 (t, J=6.8 Hz, 3H).

Synthesis of dilinoleyl methanol. To a suspension of Mg (0.897 g, 36.9 mmol) and ether (20 mL) in RB flask was added linoleyl bromide (10.0 g, 30.4 mmol) in ether (25 mL) dropwise while keeping the reaction under gentle reflux by cooling the RB flask in water. The reaction mixture was stirred at 35° C. for 1 hour. To the above reaction mixture at 0° C. was added ethyl formate (1.013 g, 13.68 mmol) in ether (30 mL) dropwise for 10 minutes and the reaction mixture was stirred at room temperature for 1.5 hrs. The reaction mixture was cooled in ice bath, quenched with water (30 mL), treated with 10% $H_2SO_4$ (150 mL) until the solution became homogeneous and the layer was separated. The aqueous layer was extracted with ether (200 mL×2). The solvent was evaporated under reduced pressure to give a residue, which was re-dissolved in THE (50 mL) and 1 N NaOH (30 mL). The reaction mixture was stirred at 40° C. for 5 hrs. TLC was used to monitor the reaction progress. If not complete, 1.5 g NaOH was added to the reaction mixture and the reaction mixture was continually stirred at 40° C. for overnight. The reaction mixture was extracted with ether (2×), dried over anhydrous sodium sulfate, and concentrated to give a residue, which was purified by ISCO (120 g gold silica gel cartridge) eluting with hexane to 10% EtOAc in hexane to give dilinoleyl methanol (5.16 g, 9.76 mmol, 71.3% yield) as a colorless oil. $^1$H NMR (500 MHz, Chloroform-d) δ 5.41-5.30 (m, 8H), 3.58 (s, 1H), 2.77 (t, J=6.7 Hz, 4H), 2.05 (q, J=6.9 Hz, 8H), 1.49-1.25 (m, 40H), 0.89 (t, J=6.8 Hz, 6H).

Synthesis of 2-cyanoethyl ((6Z,9Z,28Z,31Z)-heptatriaconta-6,9,28,31-tetraen-19-yl) diisopropylphosphoramidite. To a solution of dilinoleyl methanol (2.5 g, 4.73 mmol) in anhydrous dichloromethane (30 mL) at room temperature was added DIPEA (4.12 mL, 23.63 mmol) and 3-(chloro(diisopropylamino)phosphino)propanenitrile (1.180 mL, 5.67 mmol). The reaction mixture was stirred at room temperature for 2 hours. The reaction mixture was added EtOAc (300 mL), washed with sat sodium bicarbonate, dried over anhydrous sodium sulfate, and concentrated under reduced pressure to give a residue, which was purified by ISCO (40 g gold silica gel cartridge) eluting with hexane to 5% EtOAc in hexane containing 5% TEA to give 2-cyanoethyl (6Z,9Z,28Z,31Z)-heptatriaconta-6,9,28,31-tetraen-19-yl diisopropylphosphoramidite (2.97 g, 4.07 mmol, 86% yield) as a colorless oil. $^1$H NMR (500 MHz, Chloroform-d) δ 5.30-5.41 (m, 8H), 3.85-3.72 (m, 3H), 3.59 (dp, J=10.2, 6.8 Hz, 2H), 2.77 (t, J=6.8 Hz, 4H), 2.61 (t, J=6.6 Hz, 2H), 2.05 (q, J=7.1 Hz, 8H), 1.60-1.46 (m, 4H), 1.42-1.27 (m, 36H), 1.18 (dd, J=6.8, 3.0 Hz, 12H), 0.89 (t, J=6.8 Hz, 6H). $^{31}$P NMR (202 MHz, Chloroform-d) δ 147.68.

Synthesis of amidite from lauryl alcohol. To a solution of lauryl alcohol (5.2 g, 28 mmol) in 60 mL dry DCM, under an atmosphere of argon, at room temperature was added DIPEA (18 g, 140 mmol) and stirred for 5 minutes. To this solution was added 2-cyanoethyl N,N-diisopropylchlorophosphoramidite (7.9 g, 33.5 mmol) dropwise and stirred for 4 hours. Solvent from the reaction mixture was evaporated under reduced pressure, diluted with 300 mL ethyl acetate, washed with sat. $NaHCO_3$ and dried over anhydrous sodium sulfate. Removal of solvent and column chromatography over silica gel (80 g regular silica, 0-30% ethyl acetate in hexane containing 5% triethyl amine) using ISCO provided the product. Weight of product obtained: 3.8 g (35%). $^1H$ NMR (500 MHz; $CDCl_3$): δ 3.88-3.76 (m, 2H), 3.68-3.55 (m, 4H), 2.62 (t, 2H), 1.62-1.35 (m, 2H), 1.32-1.28 (m, 18H), 1.19-1.17 (m, 12H), 0.87 (t, 3H). $^{31}P$ NMR (202.4 MHz; $CDCl_3$): δ 147.2 (s). The product was utilized to incorporate Mod030 using oligonucleotide synthesis chemistry by reacting with 5'-OH of oligonucleotide chain. Similar procedures were employed for Mod031, Mod032, and Mod033.

Example 12. Example Synthesis of Amidites for Mod030-Mod033

To a solution of lauryl alcohol (5.2 g, 28 mmol) in 60 mL dry DCM, under an atmosphere of argon, at room temperature was added DIPEA (18 g, 140 mmol) and stirred for 5 minutes. To this solution was added 2-cyanoethyl N,N-diisopropylchlorophosphoramidite (7.9 g, 33.5 mmol) dropwise and stirred for 4 hours. Solvent from the reaction mixture was evaporated under reduced pressure, diluted with 300 mL ethyl acetate, washed with sat. $NaHCO_3$ and dried over anhydrous sodium sulfate. Removal of solvent and column chromatography over silica gel (80 g regular silica, 0-30% ethyl acetate in hexane containing 5% triethyl amine) using ISCO afforded the product. Weight of product obtained: 3.8 g (35%). $^1H$ NMR (500 MHz; $CDCl_3$): δ 3.88-3.76 (m, 2H), 3.68-3.55 (m, 4H), 2.62 (t, 2H), 1.62-1.35 (m, 2H), 1.32-1.28 (m, 18H), 1.19-1.17 (m, 12H), 0.87 (t, 3H). $^{31}P$ NMR (202.4 MHz; $CDCl_3$): δ 147.2 (s). Amidites for Mod031, Mod032 and Mod033 were prepared using the same procedure. These amidites were used as the last amidite in the synthesis cycle to prepare oligonucleotides comprising Mod030-Mod033.

Example 13. Example Preparation of Acid for Mod024

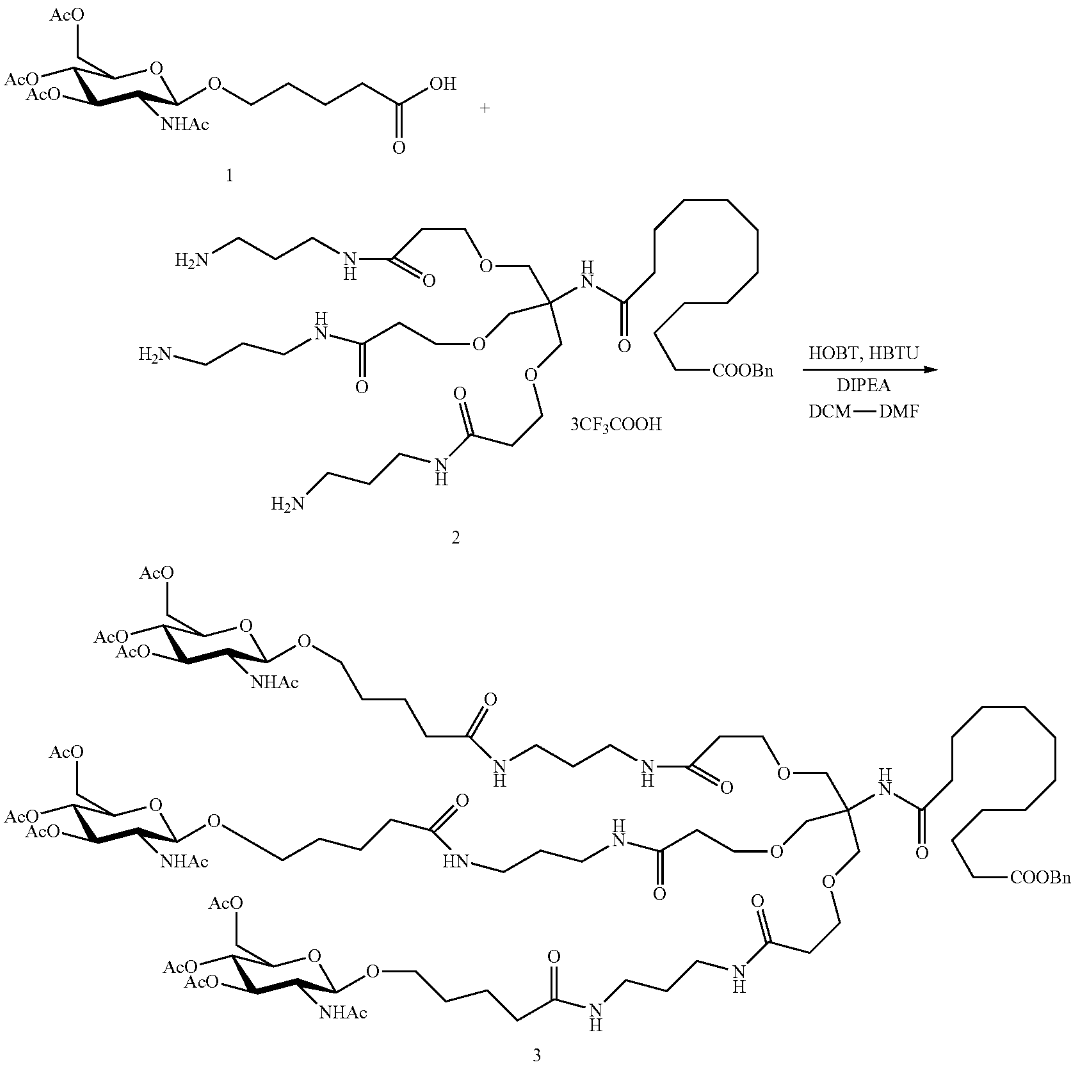

GlucNAc acid 1 (WO 2014/025805 A1) (1.88 g, 4.2 mmol) and HOBT (0.73 g, 5.4 mmol) was stirred in anhydrous DMF-DCM mixture (11+15 mL) under nitrogen at room temperature for 10 minutes. HBTU (2.05 g, 5.4 mmol) was added followed by DIPEA (2.17 g, 16.8 mmol) at 10° C. To this solution was added tri-amine salt 2 (WO 2014/025805 A1) (1.38 g, 1.2 mmol) and stirred overnight. Solvent was removed under vacuum and the residue was dissolved in ethyl acetate (200 mL). To this solution was added 100 ml of a mixture of sat. ammonium chloride, sat. sodium chloride, sat. sodium bicarbonate and water (1:1:1:1). The ethyl acetate layer was turbid initially. After thoroughly shaking the layers got separated. Aqueous layer was extracted with ethyl acetate (×2). Combined organic fractions were washed with brine and dried over anhydrous sodium sulfate. Solvent removal under reduced pressure afforded 490 mg of crude product. This product was purified by CC on an ISCO machine. The eluent was DCM-Methanol (0-20% methanol in DCM). Amount of product obtained was 1.26 g (50%). LC-MS (+ mode): 1768 (M−1GlucNAc), 1438 (M−2 GlucNAc), 1108 (M−3 GlucNAc), 1049 (M/2+1).

To a solution of benzyl ester 4 (0.25 g, 0.119 mmol) in 7 mL dry methanol, under an atmosphere of argon, 10% Pd/C (50 mg) was added followed by 1.5 mL (9.4 mmol) triethylsilane (TES) drop wise. A vigorous reaction set in and the RM was stirred for 3 hours. LC-MS analysis of the product indicates completion of reaction. The RM was filtered over celite and solvent was removed under vacuum. The crude product was triturated (×3) with ether-methanol (3:1) mixture and dried under vacuum. This product 5 was used for conjugation with oligonucleotide chains without further purification, and after conjugation the hydroxyl groups were deprotected, for example, during cleavage and/or deprotection of oligonucleotides to incorporate Mod024. If desired, a number of protocols can be utilized to deprotect the hydroxyl groups in 5 to provide the acid with deprotected hydroxyl groups. $^{1}$H NMR (500 MHz, DMSO-D6): δ 7.90 (3H, d, J=10 Hz), 7.80 (t, 3H), 7.70 (t, 3H), 5.03 (t, 3H), 4.77 (t, 3H), 4.54 (3H, d, J=10 Hz), 4.14 (3H, dd, $J_1$=9 Hz, $J_2$=5 Hz), 3.97-3.93 (m, 3H), 3.79-3.74 (m, 3H), 3.69-3.61 (m, 6H), 3.51-3.47 (m, 3H), 3.40-3.35 (m, 3H), 3.31 (d, 3H, J=9 Hz), 2.98 (m, 12H), 2.23 (t, 3H), 2.13 (t, 3H), 2.01-1.99 (m, 3H), 1.97 (s, 9H), 1.92 (s, 9H), 1.86 (s, 9H), 1.71 (s, 9H),

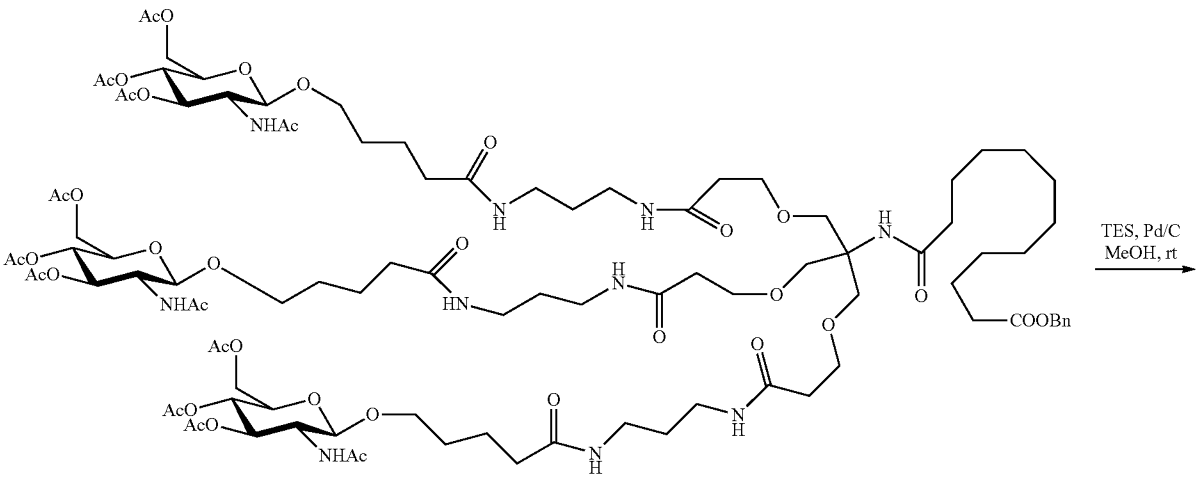

4

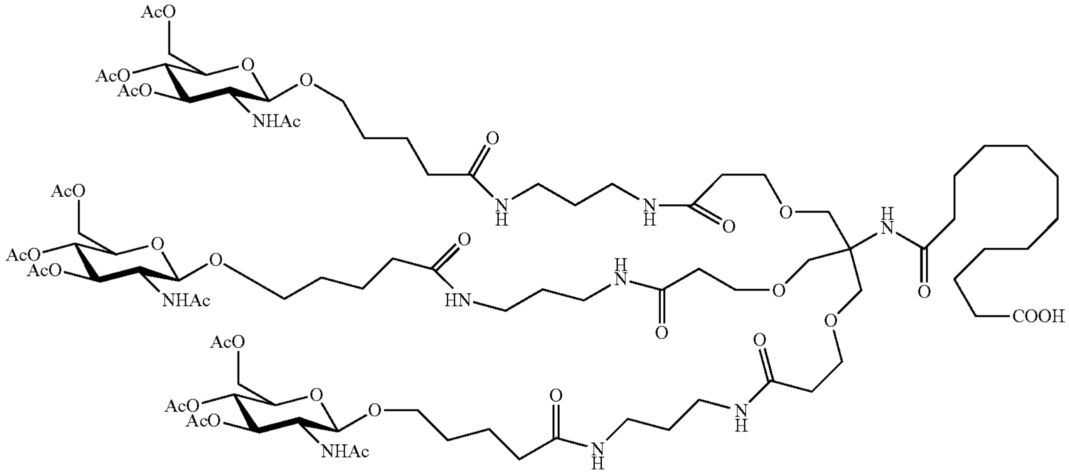

5

1.49-1.32 (m, 22H), 1.18 (br s, 12H). Mod026 were incorporated using similar strategies.

Example 14. Example Procedure for Conjugation—Preparing Oligonucleotide Chains with Amino Groups As appreciated by a person having ordinary skill in the art, various technologies, e.g., linkers, methods, functional groups, etc. can be utilized to prepare provided oligonucleotides in accordance with the present disclosure, including those comprising lipid moieties and/or targeting components. Below are example procedures for preparing oligonucleotides with amino groups for incorporating various moieties, e.g., lipid moieties, targeting components, etc.

"On Support" Conjugation Strategy

Preparation of 5'-amino-modified oligonucleotides for "on support" conjugation was carried out using MMT-amino C6 CE phosphoramidite (ChemGenes Corporation catalog No. CLP-1563 or Glen Research catalog No. 10-1906), which was added as the last phosphoramidite and coupled to 5'-OH of the oligonucleotide chain on solid support using oligonucleotide synthesis chemistry. After coupling, the newly formed linkage was optionally oxidized to provide a phosphodiester linkage if desired using, for example, tert-butyl hydroperoxide (e.g., 1.1 M in 20:80 decane/dichloromethane), $I_2$ (e.g., in pyridine/water, THF/pyridine/water, etc.), etc., depending on the oligonucleotide synthesis chemistry. When a phosphorothioate linkage was desired, PolyOrg Sulfa (e.g., 0.1 M in acetonitrile) or DDTT (e.g., 0.1 M in pyridine) was used for sulfurization. The MMT protecting group was then removed while the oligonucleotide was on support with deblocking reagent (e.g., 3% trichloroacetic acid in dichloromethane, 3% dichloroacetic acid in toluene, etc.) until the yellow color was no longer observed. Various compounds, e.g., fatty acids, sugar acids, etc. were then coupled, and optionally followed by cleavage from the support, deprotection and/or purification.

"In Solution" Conjugation Strategy

Preparation of 5'-amino-modified oligonucleotides for "in solution" conjugation strategy was carried out using TFA-amino C6 CED phosphoramidite (ChemGenes Corporation catalog No. CLP-1553 or Glen Research catalog No. 10-1916), which was added as the last phosphoramidite and coupled to 5'-OH of the oligonucleotide chain on solid support using oligonucleotide synthesis chemistry. After coupling, the newly formed linkage was optionally oxidized to provide a phosphodiester linkage if desired using, for example, tert-butyl hydroperoxide (e.g., 1.1 M in 20:80 decane/dichloromethane), $I_2$ (e.g., in pyridine/water, THF/pyridine/water, etc.), etc., depending on the oligonucleotide synthesis chemistry. When a phosphorothioate linkage was desired, PolyOrg Sulfa (e.g., 0.1 M in acetonitrile) or DDTT (e.g., 0.1 M in pyridine) was used for sulfurization. The amine-modified oligonucleotides were then cleaved from the support, deprotected and purified to provide products with free amino groups for conjugation. Usually the TFA group was removed during cleavage and deprotection of the oligonucleotides. The oligonucleotides were then utilized for conjugation

Example 15. Example Procedure for Conjugation on Solid Support

As appreciated by a person having ordinary skill in the art, a number of widely known and practiced technologies, e.g., reagents, methods, etc., can be utilized to prepare provided oligonucleotide compositions, including those comprising lipid moieties, in accordance with the present disclosure. Two example schemes are provided in the present and following examples for illustration of conjugation of lipids, targeting components, etc. to oligonucleotides. In some embodiments, $R^{LD}$—COOH is a fatty acid as described herein (prepared and/or commercially available) to provide $R^{LD}$ as illustrated in provided oligonucleotides, e.g., certain example oligonucleotides in Table 4. In some embodiments, $R^{LD}$—COOH is an acid comprising targeting component (prepared and/or commercially available) as described herein to provide $R^{LD}$ as illustrated in provided oligonucleotides, e.g., certain example oligonucleotides in Table 4.

Example procedure for conjugation on solid support:

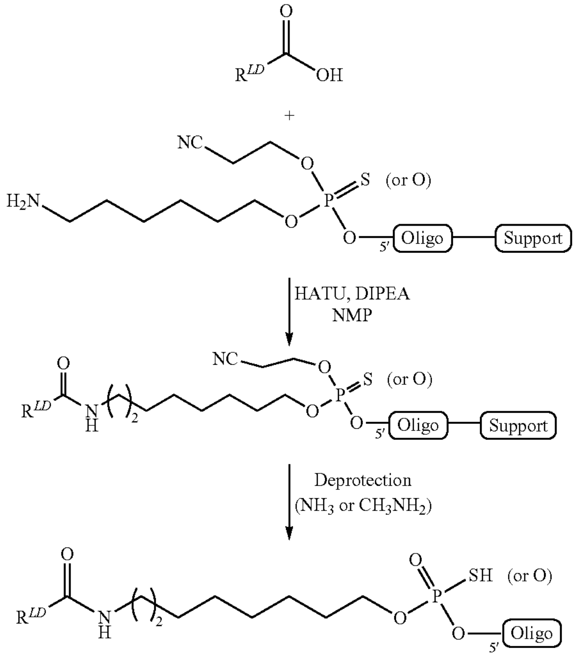

In an example procedure, a mixture of a lipid acid (1 μmol, 1 eq.), HATU (0.9 eq), diisopropylethylamine (10 eq) and NMP (500 μl) was shaken well at room temperature for 10 minutes, in a 3 mL plastic vial. This activated acid was pipetted into a plastic vial containing oligonucleotides (e.g., see example above) on solid support (0.09 μmol, 0.9 eq). The contents of the vial was thoroughly mixed and shaken well for 12 hours. After this time the supernatant NMP was removed carefully. The solid support was washed with acetonitrile (1 mL×3) and dried in a speed vac. A 1:1 mixture (1 mL) of ammonium hydroxide and methyl amine (AMA) was added and heated at 35° C. for 1 hour with intermittent shaking. After 1 hour, the CPG was transferred into a small filtration cartridge, filtered, washed with DMSO (500 μl×2) and washed with water (1 mL×3). Filtrate and washings were combined and diluted to 10 mL using water. This solution was cooled to 0° C. and neutralized with glacial acetic acid until pH of the solution reached 7.5. (Alternatively the dried solid support can be treated with 35% $NH_{40}H$ at 60° C. for 12 hours, cooled, filtered and neutralized with glacial acetic acid. For oligos containing fluoro group at 2' position, a mixture of 35% ammonium hydroxide and ethanol (3:1) was used with temperature not exceeding 40° C.). Crude product was analyzed by UV spectrometer, reverse phase HPLC and LC-MS. Purification of the crude product was done by RP-HPLC. After HPLC purification each fraction was analyzed by RP-HPLC and LC-MS. Pure fractions were combined and solvent was removed under vacuum (speed vac). Residue was dissolved in water and desalted (Triethyl ammonium ion was replaced with sodium ion) on a C-18 cartridge. Solvent was removed on a speed vac and the residue was filtered through a centrifugal filter (Amicon Ultra-15 by Millipore), lyophilized and analyzed.

For example, for synthesis of WV-2578, a mixture of lauric acid (11.01 mg, 0.0549 mmol), HATU (19 mg, 0.050 mmol) and diisopropylethyl amine (18 μL, 0.1 mmol) was dissolved in 500 μL of dry NMP and shaken well for five minutes. This activated acid was pipetted into a plastic vial containing oligonucleotides on solid support (70.5 mg, 0.005 mmol). The contents of the vial was thoroughly mixed and shaken well for 12 hours. After this time supernatant NMP was removed carefully. The solid support was washed with acetonitrile (1 mL×3) and dried in a speed vac. A 1:1 mixture (1 mL) of ammonium hydroxide and methyl amine (AMA) was added and heated at 35° C. for 1 hour with intermittent shaking. After 1 hour, the CPG was transferred into a small filtration cartridge, filtered, washed with DMSO (500 μL×2) and washed with water (1 mL×3). Filtrate and washings were combined and diluted to 10 mL using water. This solution was cooled to 0° C. and neutralized with glacial acetic acid until pH of the solution reached 7.5. Purification of the crude product was done by RP-HPLC. After HPLC purification each fraction was analyzed by RP-HPLC and LC-MS. Pure fractions were combined and solvent was removed under vacuum (speed vac). Residue was dissolved in water and desalted (triethyl ammonium ion was replaced with sodium ion) on a C-18 cartridge. Solvent was removed on a speed vac and the residue was filtered through a centrifugal filter (Amicon Ultra-15 by Millipore), lyophilized and analyzed. Average mass of WV2578 calculated: 7355, found (deconvoluted mass): 7358. Additional examples include:

| EXP* | CPG (5 μmol) | Acid (55 μmol) |
|---|---|---|
| 1 | 70.5 | Lauric acid (MW = 200.32) 11.01 mg |
| 2 | 70.5 | Myristic Acid (MW = 228.38) 12.56 mg |
| 3 | 70.5 | Palmitic acid (MW = 256.26) 14.1 mg |
| 4 | 70.5 | Stearic acid (MW = 284.27) 15.63 mg |
| 5 | 70.5 | Oleic acid (MW = 282.47) 15.53 g |
| 6 | 70.5 | Linolenic acid (MW = 280.45) 15.4 mg |
| 7 | 70.5 | α-Linolenic acid (MW = 278.44) 15.3 mg |
| 8 | 70.5 | γ-Linolenic acid (MW = 278.44) 15.3 mg |
| 9 | 70.5 | cis-DHA (MW = 328.24) 18.05 mg |
| 10 | 70.5 | Turbinaric acid (MW = 400.36) 22 mg |

*HATU (50 μmol, MW = 379.24, 19 mg), DIPEA (MW = 129, d = 0.726, 100 μmol, 18 μL), NMP 500 μL).

| Oligo-nucleotide | Conjugated Acid | Total ODs | Amount (μmol) | Amount (mg) |
|---|---|---|---|---|
| WV2578 | Lauric Acid | 287 | 1.40 | 9.79 |
| WV2579 | Myristic Acid | 331 | 1.62 | 11.29 |
| WV2580 | Palmitic Acid | 268 | 1.31 | 9.14 |
| WV2581 | Stearic Acid | 265 | 1.30 | 9.04 |
| WV2582 | Oleic Acid | 262 | 1.28 | 8.94 |
| WV2583 | Linoleic Acid | 120 | 0.59 | 4.09 |
| WV2584 | α-Linolenic Acid | 285 | 1.39 | 9.72 |
| WV2585 | γ-Linolenic Acid | 297 | 1.45 | 10.13 |

-continued

| Oligo-nucleotide | Conjugated Acid | Total ODs | Amount (μmol) | Amount (mg) |
|---|---|---|---|---|
| WV2586 | cis-DHA | 274 | 1.34 | 9.35 |
| WV2587 | Turbinaric acid | 186 | 0.91 | 6.35 |
| WV2588 | Dilinoleyl* | 345 | 1.69 | 11.77 |

*Synthesized on a solid support; last cycle using 2-cyanoethyl ((6Z, 9Z, 28Z, 31Z)-heptatriaconta-6,9,28,31-tetraen-19-yl) diisopropylphosphoramidite.

Example 16. Example Procedure for Conjugation in Solution

In some embodiments, provided oligonucleotides were prepared in solution phase.

Example procedure for conjugation in liquid phase:

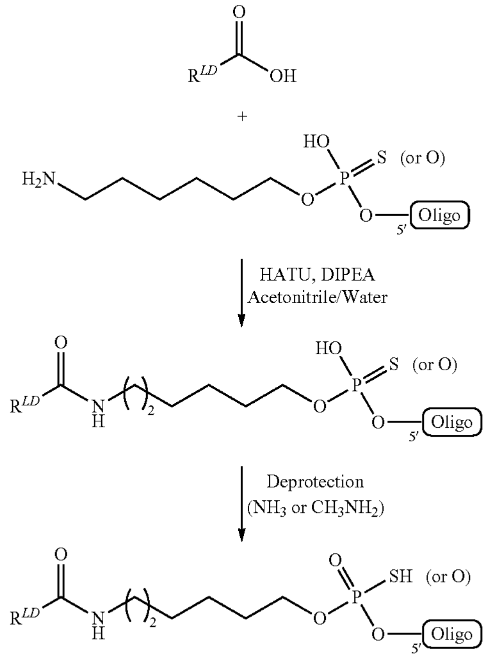

In an example procedure, a mixture of the lipid acid (1 eq.), HATU (1 eq.) and DIPEA (10 eq.) was mixed well in dry AcCN (10 mL) and kept for 10 minutes. This activated acid was added to the oligonucleotide (5 μmol) in water (5 mL) and mixed well on a vortex. This reaction was shaken for 1 hour. After 1 hour completion of the reaction was checked by LC-MS (usually the reaction is complete in 1 hour; if not, more acid-HATU complex can be added to drive the reaction to completion). Acetonitrile and water was removed under vacuum on a speed vac. The solid obtained was treated with 35% ammonium hydroxide (15 mL) and shaken at 60° C. for 12 hours; for 2' fluoro oligonucleotides a 3:1 mixture of 35% ammonium hydroxide and ethanol was used for deprotection). After 12 hours solvent was removed under vacuum and diluted with water (15 mL), analyzed by LC-MS and RP-HPLC. Crude product was then purified by RP-HPLC and desalted.

For example, for synthesis of WV-3546, turbinaric acid (7 mg, 0.0174 mmol), HATU (6.27 mg, 0.0165 mmol) and DIPEA (22.2 mg, 0.172 mmol) was mixed well in dry AcCN (10 mL) and kept for 5 minutes in a 40 mL plastic vial. This activated acid was added to oligonucleotides in 3.77 mL water (80 mg, 0.0117 mmol) and mixed well on a vortex. This reaction was shaken for 2 hours. After 2 hours completion of the reaction was checked by LC-MS (reaction was complete). Acetonitrile and water was removed under vacuum on a speed vac. The solid obtained was treated with ammonia:ethanol mixture (3:1, 15 mL) and shaken at 40° C. for 12 hours. After 12 hours solvent was removed under vacuum and diluted with water (~15 mL) and analyzed by LC-MS. Crude product was purified by RP-HPLC (50 mM triethyl ammonium acetate in water-acetonitrile system (0-70% acetonitrile in 45 minutes), X Bridge preparative C8 (19×250 mm column))_. Average mass of WV3546 calculated: 7295. Mass found (deconvoluted mass): 7295.

Example 17. Example Synthesis of MMT-C6-Amino DPSE-L Amidite

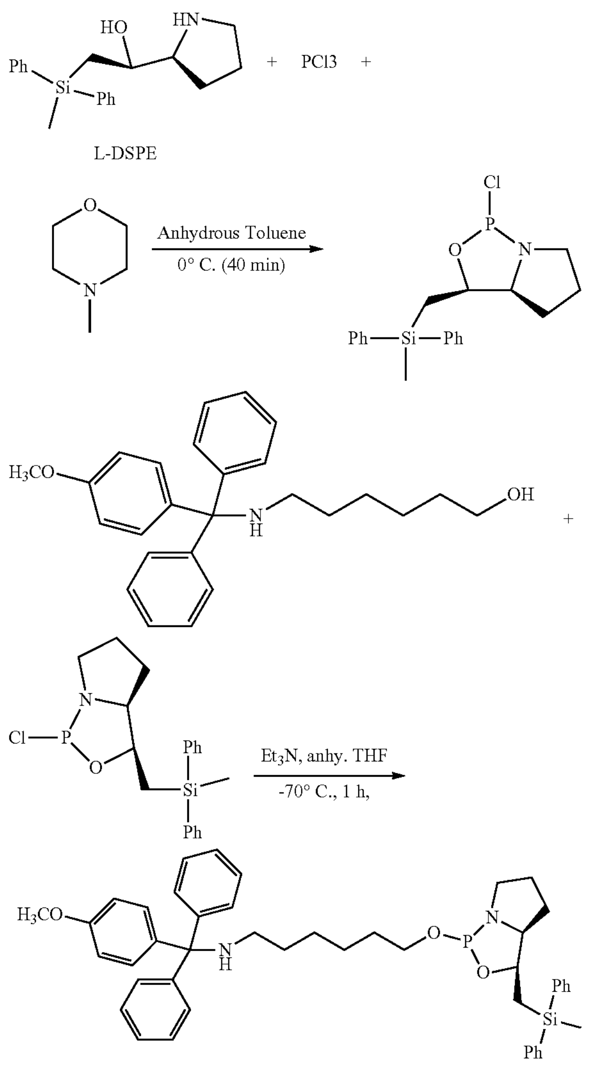

Preparation of chlorooxazaphospholidine: L-DPSE (37.1 g, 119 mmol) was dried by azeotropic evaporation with anhydrous toluene (150 mL) at 35° C. in a rotaevaporator and left in high vacuum for overnight. Then a solution of this dried L-DPSE (37.1 g) and 4-methylmorpholine (26.4 mL, 24.31 g, 240 mmol) dissolved in anhydrous toluene (150 mL) was added to an ice-cold solution of trichlorophosphine (16.51 g, 10.49 mL, 120 mmol) in anhydrous toluene (110 mL) placed in three neck round bottomed flask through cannula under Argon (start Temp: 0.6° C., Max: temp 14° C., 25 min addition) and the reaction mixture was stirred at 0° C. for 40 min. After that the precipitated white solid was filtered by vacuum under argon using spacial filter tube (Chemglass: Filter Tube, 24/40 Inner Joints, 80 mm OD Medium Frit, Airfree, Schlenk). The solvent was removed by rotaevaporator under argon at low temperature (25° C.) followed by dried under vacuum overnight (~15 h) and the oily chlorooxazaphospholidine obtained was used for the next step.

MMT-C6-amino DPSE-L amidite: 6-(monomethoxytritylamino)hexan-1-ol (7.0 g, 17.97 mmol) was first dried by azeotropic evaporation by anhydrous toluene (50 ml) and dried under vacuum for overnight. Then the dried 6-(monomethoxytritylamino)hexan-1-ol was dissolved in anhydrous THE (80 mL) and added triethylamine (9.0 g, 90 mmol) and then the reaction solution was cooled to −70° C. To this cooled solution was added chlorooxazaphospholidine (6.76 g, 17.97 mmol) dissolved in anhydrous THF (50 mL) over 10 min. After the reaction mixture slowly warmed to room temperature (~1 h), TLC indicated complete conversion of starting material. Then the reaction mixture was filtered carefully under vacuum/argon using the fitted filtration tube to remove precipitated solid, and washed with THE (80 mL). The solution was evaporated at 25° C. and the resulting oily residue was dissolved in Hexane-$CH_2Cl_2$ mixture with 5% TEA and purified using ISCO Combi-Flash system 220 g silica column (which was pre-de-activated with 3 CV MeOH, then equilibrated with ethyl acetate (5% TEA) 3 CV), with Hexane-EtOAc mixture (5% TEA). Pure fractions were collected and concentrated, dried overnight to afford MMT-C6-amino DPSE-L amidite as a colorless oily liquid. Yield: 8.0 g (62%). MS: calculated: 728.38; found by LCMS analysis at +Ve ion mode m/z: 729.54 ($M^+$ ion), 747.50 ($M^+$+18, H2O). $^1$H-NMR (500 MHz, $CDCl_3$): δ 7.58-7.43 (m, 8H), 7.41-7.31 (m, 6H), 7.31-7.23 (m, 6H), 7.17 (t, J=7.2 Hz, 2H), 6.81 (d, J=8.7 Hz, 2H), 4.82 (dt, J=8.7, 5.7 Hz, 1H), 3.78 (s, 3H), 3.77-3.73 (m, 1H), 3.54 (qt, J=11.0, 5.2 Hz, 2H), 2.54 (q, J=7.2 Hz, 3H), 2.11 (t, J=7.0 Hz, 2H), 1.64-1.57 (m, 4H), 1.51-1.35 (m, 6H), 1.26 (q, J=9.9, 8.0 Hz, 2H), 1.04 (t, J=7.1 Hz, 2H), 0.67 (s, 3H). $^{13}$C NMR (500 MHz, $CDCl_3$) δ 157.87, 146.73, 146.67, 138.63, 136.89, 136.43, 134.71, 134.57, 134.48, 129.88, 129.46, 129.42, 128.66, 128.05, 127.96, 127.87, 127.81, 126.17, 113.13, 78.14, 78.07, 77.48, 77.43, 77.22, 76.97, 70.45, 68.03, 68.01, 63.50, 63.40, 55.22, 47.46, 47.17, 46.40, 43.69, 34.79, 31.34, 31.07, 27.19, 27.09, 26.04, 25.98, 17.60, 11.78, −3.17. $^{31}$P-NMR (500 MHz, $CDCl_3$): δ 154.27 (92.18%), 157.68 (3.56%), 146.35 (4.26%).

Example 18. Example Preparation of WV-4107

Oligonucleotides were prepared using conditions for WV-3473 with all protecting groups and auxiliaries on and remained on solid support (if cleaved and deprotected, would provide WV-3473) using provided oligonucleotide technologies. In an example procedure, DPSE chemistry and GE Primer Support 5G (2.1 g), and the following cycles were used:

| step | operation | reagents and solvent | volume per cycle | waiting time |
|---|---|---|---|---|
| 1 | detritylation | 3% DCA in toluene | ~150 mL | ~6 min |
| 2 | coupling | 0.175M monomer in MeCN or 20% iso-butyronitrile in MeCN + 0.6M CMIMT in MeCN | 21 mL | 8 min |
| 3 | capping | 20% $Ac_2O$, 30% 2,6-lutidine in MeCN + 20% MeIm in MeCN | 23 mL | 1.5 min |
| 4 | oxidation or sulfurization | 1.1M TBHP in DCM-decane or 0.1M POS in MeCN | 44 mL or 39 mL | 2 min or 6 min |

After the last cycle, a portion of the oligonucleotides can be cleaved and deprotected for QC or other purposes. In an example procedure the oligonucleotides on support were washed with 6 column volumes of 20% diethylamine in acetonitrile for 15 min followed by an acetonitrile wash. The support was dried and then incubated in 1 M triethylamine hydrofluoride in 3:1 dimethylformamide/water for 1-1.5 h at 50° C. The sample was filtered and washed with acetonitrile and dried. The support was then incubated overnight at 40° C. in 3:1 ammonium hydroxide/ethanol.

For preparation of WV-4107, after the last cycle the DMT protecting group was removed using 3% dichloroacetic acid in toluene. During the coupling step, MMT-C6-amino DPSE-L amidite (0.175 M in isobutyronitrile) and CMIMT activator (0.6 M in acetonitrile) were added with a contact time of 8 min. The percent volume of activator was 55%. Capping was performed with 20% 1-methylimidazole in acetonitrile and 20/30/50 acetic anhydride/2,6-lutidine/acetonitrile. Sulfurization was performed using 0.1 M PolyOrg Sulfa in acetonitrile.

The MNT protecting group was then removed while the oligonucleotide was on support with deblocking reagent (3% dichloroacetic acid in toluene) until the yellow color was no longer observed, providing WV-4191. Stearic acid was then coupled to the amine using described procedure above. The oligonucleotides on support were washed with 20% diethylamine in acetonitrile for 30 min at room temperature followed by an acetonitrile wash. The support was dried and then incubated in 1 M triethylamine hydrofluoride in 3:1 dimethylformamide/water for 1-1.5 h at 50° C. The sample was filtered and washed with acetonitrile and dried. The support was then incubated overnight at 40° C. in 3:1 ammonium hydroxide/ethanol. The crude product was further purified using RP-HPLC to provide WV-4107.

Example 19. Example Preparation of Oligonucleotides with Mod021

Oligonucleotide was synthesized at a scale of 10 μmol using standard cyanoethyl phosphoramidite chemistry and was left on support with protecting groups using cycle conditions for WV-942 (if cleaved and deprotected, would provide WV-942). The DMT protecting group was removed using 3% trichloroacetic acid in dichloromethane. The lipid amidite was then added to the 5' end of the oligonucleotide on the synthesizer. During the coupling step, equal volumes of lipid amidite (e.g., 0.1 M in isobutyronitrile) and 5-ethylthio tetrazole (e.g., 0.5 M in acetonitrile) were added with a contact time of, e.g., 5 min. The coupling step was optionally repeated a second time. Sulfurization was performed using 0.1 M DDTT in pyridine. The oligonucleotide was cleaved and deprotected using AMA condition (ammonium hydroxide/40% aqueous methylamine 1:1 v/v) to provide WV-2588.

Example 20. Example Preparation of Oligonucleotides with Mod030, Mod031, Mod032 and Mod033

Oligonucleotides were synthesized using cyanoethyl phosphoramidite chemistry as for WV-2735 and were left on support with the protecting group on (if cleaved and deprotected, would provide WV-2735). The 5'-DMT protecting group was removed using 3% trichloroacetic acid in dichloromethane. The lipid amidites were then added to the 5' end of the oligonucleotide on the synthesizer. During the coupling step, equal volumes of lipid amidite (0.1M in isobutyronitrile or dichloromethane) and 5-ethylthio tetrazole (0.5M in acetonitrile) were added with a contact time of 10 min. The coupling step was repeated again. Oxidation was performed using 0.02 M $I_2$ in THF/pyridine/water. The oligonucleotides were de-protected with 20% diethylamine in acetonitrile wash followed by an acetonitrile wash. The oligonucleotides were cleaved from the support and further de-protected in ammonium hydroxide at 50° C. overnight.

Product oligonucleotides were characterized in various chemical analyses, e.g., UV, HPLC-MS, etc., (for example MS data, see Table 6) and biological assays, e.g., those described herein. Following similar procedures and/or using widely known and practiced technologies in the art, other example provided oligonucleotides were or can be readily prepared and characterized in accordance with the present disclosure.

EQUIVALENTS

Having described some illustrative embodiments of the disclosure, it should be apparent to those skilled in the art that the foregoing is merely illustrative and not limiting, having been presented by way of example only. Numerous modifications and other illustrative embodiments are within the scope of one of ordinary skill in the art and are contemplated as falling within the scope of the disclosure. In particular, although many of the examples presented herein involve specific combinations of method acts or system elements, it should be understood that those acts and those elements may be combined in other ways to accomplish the same objectives. Acts, elements, and features discussed only in connection with one embodiment are not intended to be excluded from a similar role in other embodiments. Further, for the one or more means-plus-function limitations recited in the following claims, the means are not intended to be limited to the means disclosed herein for performing the recited function, but are intended to cover in scope any means, known now or later developed, for performing the recited function.

Use of ordinal terms such as “first”, “second”, “third”, etc., in the claims to modify a claim element does not by itself connote any priority, precedence, or order of one claim element over another or the temporal order in which acts of a method are performed, but are used merely as labels to distinguish one claim element having a certain name from another element having a same name (but for use of the ordinal term) to distinguish the claim elements. Similarly, use of a), b), etc., or i), ii), etc. does not by itself connote any priority, precedence, or order of steps in the claims. Similarly, the use of these terms in the specification does not by itself connote any required priority, precedence, or order.

The foregoing written specification is considered to be sufficient to enable one skilled in the art to practice the invention. The present disclosure is not to be limited in scope by examples provided, since the examples are intended as a single illustration of one aspect of the invention and other functionally equivalent embodiments are within the scope of the invention. Various modifications of the invention in addition to those shown and described herein will become apparent to those skilled in the art from the foregoing description and fall within the scope of the appended claims. The advantages and objects of the invention are not necessarily encompassed by each embodiment of the invention.

5. The method of claim 1, wherein the base sequence comprises a sequence having no more than 5 mismatches from a 20 base long portion of the dystrophin gene or its complement, the length is no more than 50 bases, and the pattern of backbone chiral centers comprises at least three chirally controlled centers independently of Rp or Sp, and the oligonucleotides of the particular oligonucleotide type are capable of mediating the skipping of an exon of the dystrophin gene.

6. The method of claim 1, wherein at least 10% of the oligonucleotides that have the base sequence of the particular oligonucleotide type are oligonucleotides of the particular oligonucleotide type.

SEQUENCE LISTING (1324 sequences)

SEQ ID NO: 1 - DNA, 20 bp, synthetic construct
  misc_feature 1..20: note = Description of Artificial Sequence: Synthetic oligonucleotide
  source 1..20: mol_type = other DNA
gcctcagtctgcttcgcacc

SEQ ID NO: 2 - DNA, 20 bp, synthetic construct
  misc_feature 1..20: note = Description of Artificial Sequence: Synthetic oligonucleotide
  source 1..20: mol_type = other DNA
gcctcagtctgcttcgcacc

SEQ ID NO: 3 - DNA, 13 bp, synthetic construct
  misc_feature 1..13: note = Description of Artificial Sequence: Synthetic oligonucleotide
  source 1..13: mol_type = other DNA
aatcgatcgatcg

SEQ ID NO: 4 - DNA, 20 bp, synthetic construct
  misc_feature 1..20: note = Description of Artificial Sequence: Synthetic oligonucleotide
  source 1..20: mol_type = other DNA
gcctcagtctgcttcgcacc

SEQ ID NO: 5 - DNA, 20 bp, synthetic construct
  misc_feature 1..20: note = Description of Artificial Sequence: Synthetic oligonucleotide
  source 1..20: mol_type = other DNA
gcctcagtctgcttcgcacc

SEQ ID NO: 6 - RNA, 20 nt, synthetic construct
  misc_feature 1..20: note = Description of Artificial Sequence: Synthetic oligonucleotide
  source 1..20: mol_type = other RNA
ggcacaagggcacagacttc

SEQ ID NO: 7 - RNA, 20 nt, synthetic construct
  misc_feature 1..20: note = Description of Artificial Sequence: Synthetic oligonucleotide
  source 1..20: mol_type = other RNA
ggcacaagggcacagacttc

SEQ ID NO: 8 - DNA, 10 bp, synthetic construct
  misc_feature 1..10: note = Description of Artificial Sequence: Synthetic oligonucleotide
  source 1..10: mol_type = other DNA
aagggcacag

SEQ ID NO: 9 - DNA, 10 bp, synthetic construct
  misc_feature 1..10: note = Description of Artificial Sequence: Synthetic oligonucleotide
  source 1..10: mol_type = other DNA
gggacgtctt

SEQ ID NO: 10 - DNA, 20 bp, synthetic construct
  misc_feature 1..20: note = Description of Artificial Sequence: Synthetic oligonucleotide
  source 1..20: mol_type = other DNA
ggcacaagggcacagacttc

SEQ ID NO: 11 - RNA, 25 nt, synthetic construct
  misc_feature 1..25: note = Description of Artificial Sequence: Synthetic oligonucleotide
  source 1..25: mol_type = other RNA
tttggaagtctgtgcccttgtgccc

SEQ ID NO: 12 - DNA, 20 bp, synthetic construct
  misc_feature 1..20: note = Description of Artificial Sequence: Synthetic oligonucleotide
  source 1..20: mol_type = other DNA
gcctcagtctgcttcgcacc

SEQ ID NO: 13 - DNA, 20 bp, synthetic construct
  misc_feature 1..20: note = Description of Artificial Sequence: Synthetic oligonucleotide
  source 1..20: mol_type = other DNA
gagcagctgcaacctggcaa

SEQ ID NO: 14 - DNA, 20 bp, synthetic construct
  misc_feature 1..20: note = Description of Artificial Sequence: Synthetic oligonucleotide
  source 1..20: mol_type = other DNA
gggcacaagggcacagactt

SEQ ID NO: 15 - DNA, 20 bp, synthetic construct
  misc_feature 1..20: note = Description of Artificial Sequence: Synthetic oligonucleotide
  source 1..20: mol_type = other DNA
gcacaagggcacagacttcc

SEQ ID NO: 16 - DNA, 20 bp, synthetic construct
  misc_feature 1..20: note = Description of Artificial Sequence: Synthetic oligonucleotide
  source 1..20: mol_type = other DNA
cacaagggcacagacttcca

SEQ ID NO: 17 - DNA, 20 bp, synthetic construct
  misc_feature 1..20: note = Description of Artificial Sequence: Synthetic oligonucleotide
  source 1..20: mol_type = other DNA
acaagggcacagacttccaa

SEQ ID NO: 18 - DNA, 20 bp, synthetic construct
  misc_feature 1..20: note = Description of Artificial Sequence: Synthetic oligonucleotide
  source 1..20: mol_type = other DNA
caagggcacagacttccaaa

SEQ ID NO: 19 - DNA, 20 bp, synthetic construct
  misc_feature 1..20: note = Description of Artificial Sequence: Synthetic oligonucleotide
  source 1..20: mol_type = other DNA
agcagctgcaacctggcaac

SEQ ID NO: 20 - DNA, 20 bp, synthetic construct
  misc_feature 1..20: note = Description of Artificial Sequence: Synthetic oligonucleotide
  source 1..20: mol_type = other DNA
gcagctgcaacctggcaaca

SEQ ID NO: 21 - DNA, 20 bp, synthetic construct
  misc_feature 1..20: note = Description of Artificial Sequence: Synthetic oligonucleotide
  source 1..20: mol_type = other DNA
cagctgcaacctggcaacaa

SEQ ID NO: 22 - DNA, 20 bp, synthetic construct
  misc_feature 1..20: note = Description of Artificial Sequence: Synthetic oligonucleotide
  source 1..20: mol_type = other DNA
agctgcaacctggcaacaac

SEQ ID NO: 23 - DNA, 20 bp, synthetic construct
  misc_feature 1..20: note = Description of Artificial Sequence: Synthetic oligonucleotide
  source 1..20: mol_type = other DNA
gctgcaacctggcaacaacc

SEQ ID NO: 24 - DNA, 20 bp, synthetic construct
  misc_feature 1..20: note = Description of Artificial Sequence: Synthetic oligonucleotide
  source 1..20: mol_type = other DNA
gggccaacagccagcctgca

SEQ ID NO: 25 - DNA, 20 bp, synthetic construct
  misc_feature 1..20: note = Description of Artificial Sequence: Synthetic oligonucleotide
  source 1..20: mol_type = other DNA
ggccaacagccagcctgcag

SEQ ID NO: 26 - DNA, 20 bp, synthetic construct
  misc_feature 1..20: note = Description of Artificial Sequence: Synthetic oligonucleotide
  source 1..20: mol_type = other DNA
gccaacagccagcctgcagg

SEQ ID NO: 27 - DNA, 20 bp, synthetic construct
  misc_feature 1..20: note = Description of Artificial Sequence: Synthetic oligonucleotide
  source 1..20: mol_type = other DNA
ccaacagccagcctgcagga

SEQ ID NO: 28 - DNA, 20 bp, synthetic construct
  misc_feature 1..20: note = Description of Artificial Sequence: Synthetic oligonucleotide
  source 1..20: mol_type = other DNA
caacagccagcctgcaggag

SEQ ID NO: 29 - DNA, 20 bp, synthetic construct
  misc_feature 1..20: note = Description of Artificial Sequence: Synthetic oligonucleotide
  source 1..20: mol_type = other DNA
aacagccagcctgcaggagg

SEQ ID NO: 30 - DNA, 20 bp, synthetic construct
  misc_feature 1..20: note = Description of Artificial Sequence: Synthetic oligonucleotide
  source 1..20: mol_type = other DNA
attaataaattgtcatcacc

SEQ ID NO: 31 - DNA, 16 bp, synthetic construct
  misc_feature 1..16: note = Description of Artificial Sequence: Synthetic oligonucleotide
  source 1..16: mol_type = other DNA
ttcagtcatgacttcc

SEQ ID NO: 32 - DNA, 16 bp, synthetic construct
  misc_feature 1..16: note = Description of Artificial Sequence: Synthetic oligonucleotide
  source 1..16: mol_type = other DNA
ttcagtcatgacttcc

SEQ ID NO: 33 - DNA, 20 bp, synthetic construct
  misc_feature 1..20: note = Description of Artificial Sequence: Synthetic oligonucleotide
  source 1..20: mol_type = other DNA
gcctcagtctgcttcgcacc

SEQ ID NO: 34 - DNA, 20 bp, synthetic construct
  misc_feature 1..20: note = Description of Artificial Sequence: Synthetic oligonucleotide
  source 1..20: mol_type = other DNA
ggcacaagggcacagacttc

SEQ ID NO: 35 - DNA, 20 bp, synthetic construct
  misc_feature 1..20: note = Description of Artificial Sequence: Synthetic oligonucleotide
  source 1..20: mol_type = other DNA
ccgtcgcccttcagcacgca

SEQ ID NO: 36 - DNA, 20 bp, synthetic construct
  misc_feature 1..20: note = Description of Artificial Sequence: Synthetic oligonucleotide
  source 1..20: mol_type = other DNA
ccgtcgcccttcagcacgca

SEQ ID NO: 37 - DNA, 20 bp, synthetic construct
  misc_feature 1..20: note = Description of Artificial Sequence: Synthetic oligonucleotide
  source 1..20: mol_type = other DNA
ccgtcgcccttcagcacgca

SEQ ID NO: 38 - DNA, 20 bp, synthetic construct
  misc_feature 1..20: note = Description of Artificial Sequence: Synthetic oligonucleotide
  source 1..20: mol_type = other DNA
ccgtcgcccttcagcacgca

SEQ ID NO: 39 - DNA, 20 bp, synthetic construct
  misc_feature 1..20: note = Description of Artificial Sequence: Synthetic oligonucleotide
  source 1..20: mol_type = other DNA
ccgtcgcccttcagcacgca

SEQ ID NO: 40 - DNA, 20 bp, synthetic construct
  misc_feature 1..20: note = Description of Artificial Sequence: Synthetic oligonucleotide
  source 1..20: mol_type = other DNA
ccgtcgcccttcagcacgca

SEQ ID NO: 41 - DNA, 20 bp, synthetic construct
  misc_feature 1..20: note = Description of Artificial Sequence: Synthetic oligonucleotide
  source 1..20: mol_type = other DNA
gtccctgaagatgtcaatgc

SEQ ID NO: 42 - DNA, 20 bp, synthetic construct
  misc_feature 1..20: note = Description of Artificial Sequence: Synthetic oligonucleotide
  source 1..20: mol_type = other DNA
gtccctgaagatgtcaatgc

SEQ ID NO: 43 - DNA, 20 bp, synthetic construct
  misc_feature 1..20: note = Description of Artificial Sequence: Synthetic oligonucleotide
  source 1..20: mol_type = other DNA
gtccctgaagatgtcaatgc

SEQ ID NO: 44 - DNA, 20 bp, synthetic construct
  misc_feature 1..20: note = Description of Artificial Sequence: Synthetic oligonucleotide
  source 1..20: mol_type = other DNA
gtccctgaagatgtcaatgc

SEQ ID NO: 45 - DNA, 20 bp, synthetic construct
  misc_feature 1..20: note = Description of Artificial Sequence: Synthetic oligonucleotide
  source 1..20: mol_type = other DNA
gtccctgaagatgtcaatgc

SEQ ID NO: 46 - RNA, 20 nt, synthetic construct
  misc_feature 1..20: note = Description of Artificial Sequence: Synthetic oligonucleotide
  source 1..20: mol_type = other RNA
ggcacaagggcacagacttc

SEQ ID NO: 47 - RNA, 20 nt, synthetic construct
  misc_feature 1..20: note = Description of Artificial Sequence: Synthetic oligonucleotide
  source 1..20: mol_type = other RNA
ggcacaagggcacagacttc

SEQ ID NO: 48 - RNA, 20 nt, synthetic construct
  misc_feature 1..20: note = Description of Artificial Sequence: Synthetic oligonucleotide
  source 1..20: mol_type = other RNA
ggcacaagggcacagacttc

SEQ ID NO: 49 - RNA, 20 nt, synthetic construct
  misc_feature 1..20: note = Description of Artificial Sequence: Synthetic oligonucleotide
  source 1..20: mol_type = other RNA
ggcacaagggcacagacttc

SEQ ID NO: 50 - RNA, 20 nt, synthetic construct
  misc_feature 1..20: note = Description of Artificial Sequence: Synthetic oligonucleotide
  source 1..20: mol_type = other RNA
ggcacaagggcacagacttc

SEQ ID NO: 51 - RNA, 20 nt, synthetic construct
  misc_feature 1..20: note = Description of Artificial Sequence: Synthetic oligonucleotide
  source 1..20: mol_type = other RNA
ggcacaagggcacagacttc

SEQ ID NO: 52 - RNA, 20 nt, synthetic construct
  misc_feature 1..20: note = Description of Artificial Sequence: Synthetic oligonucleotide
  source 1..20: mol_type = other RNA
ggcacaagggcacagacttc

SEQ ID NO: 53 - DNA, 20 bp, synthetic construct
  misc_feature 1..20: note = Description of Artificial Sequence: Synthetic oligonucleotide
  source 1..20: mol_type = other DNA
ggcacaagggcacagacttc

SEQ ID NO: 54 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 55 - DNA, 20 bp, synthetic construct
  misc_feature 1..20: note = Description of Artificial Sequence: Synthetic oligonucleotide
  source 1..20: mol_type = other DNA
tcaaggaagatggcatttct

SEQ ID NO: 56 - DNA, 20 bp, synthetic construct
  misc_feature 1..20: note = Synthetic oligonucleotide
  modified_base 11: mod_base = OTHER; note = uracil
  source 1..20: mol_type = other DNA
tcaaggaagatggcatttct

SEQ ID NO: 57 - DNA, 20 bp, synthetic construct
  misc_feature 1..20: note = Synthetic oligonucleotide
  modified_base 1: mod_base = OTHER; note = uracil
  modified_base 17..18: mod_base = OTHER; note = uracil
  modified_base 20: mod_base = OTHER; note = uracil
  source 1..20: mol_type = other DNA
tcaaggaagatggcatttct

SEQ ID NO: 58 - DNA, 20 bp, synthetic construct
  misc_feature 1..20: note = Synthetic oligonucleotide
  modified_base 16: mod_base = OTHER; note = uracil
  modified_base 18: mod_base = OTHER; note = uracil
  modified_base 20: mod_base = OTHER; note = uracil
  source 1..20: mol_type = other DNA
tcaaggaagatggcatttct

SEQ ID NO: 59 - DNA, 20 bp, synthetic construct
  misc_feature 1..20: note = Synthetic oligonucleotide
  modified_base 1: mod_base = OTHER; note = uracil
  modified_base 11: mod_base = OTHER; note = uracil
  modified_base 17: mod_base = OTHER; note = uracil
  modified_base 20: mod_base = OTHER; note = uracil
  source 1..20: mol_type = other DNA
tcaaggaagatggcatttct

SEQ ID NO: 60 - DNA, 20 bp, synthetic construct
  misc_feature 1..20: note = Synthetic oligonucleotide
  modified_base 16..17: mod_base = OTHER; note = uracil
  modified_base 20: mod_base = OTHER; note = uracil
  source 1..20: mol_type = other DNA
tcaaggaagatggcatttct

SEQ ID NO: 61 - DNA, 20 bp, synthetic construct
  misc_feature 1..20: note = Synthetic oligonucleotide
  modified_base 11: mod_base = OTHER; note = uracil
  modified_base 16: mod_base = OTHER; note = uracil
  modified_base 20: mod_base = OTHER; note = uracil
  source 1..20: mol_type = other DNA
tcaaggaagatggcatttct

SEQ ID NO: 62 - DNA, 20 bp, synthetic construct
  misc_feature 1..20: note = Synthetic oligonucleotide
  modified_base 20: mod_base = OTHER; note = uracil
  source 1..20: mol_type = other DNA
tcaaggaagatggcatttct

SEQ ID NO: 63 - DNA, 20 bp, synthetic construct
  misc_feature 1..20: note = Synthetic oligonucleotide
  modified_base 16: mod_base = OTHER; note = uracil
  modified_base 20: mod_base = OTHER; note = uracil
  source 1..20: mol_type = other DNA
tcaaggaagatggcatttct

SEQ ID NO: 64 - DNA, 20 bp, synthetic construct
  misc_feature 1..20: note = Synthetic oligonucleotide
  modified_base 1: mod_base = OTHER; note = uracil
  modified_base 11: mod_base = OTHER; note = uracil
  modified_base 20: mod_base = OTHER; note = uracil
  source 1..20: mol_type = other DNA
tcaaggaagatggcatttct

SEQ ID NO: 65 - DNA, 20 bp, synthetic construct
  misc_feature 1..20: note = Description of Artificial Sequence: Synthetic oligonucleotide
  source 1..20: mol_type = other DNA
ggccaaacctcggcttacct

SEQ ID NO: 66 - RNA, 20 nt, synthetic construct
  misc_feature 1..20: note = Description of Artificial Sequence: Synthetic oligonucleotide
  source 1..20: mol_type = other RNA
ggccaaacctcggcttacct

SEQ ID NO: 67 - DNA, 20 bp, synthetic construct
  misc_feature 1..20: note = Synthetic oligonucleotide
  modified_base 10: mod_base = OTHER; note = uracil
  source 1..20: mol_type = other DNA
ggccaaacctcggcttacct

SEQ ID NO: 68 - DNA, 20 bp, synthetic construct
  misc_feature 1..20: note = Synthetic oligonucleotide
  modified_base 20: mod_base = OTHER; note = uracil
  source 1..20: mol_type = other DNA
ggccaaacctcggcttacct

SEQ ID NO: 69 - DNA, 20 bp, synthetic construct
  misc_feature 1..20: note = Synthetic oligonucleotide
  modified_base 10: mod_base = OTHER; note = uracil
  modified_base 16: mod_base = OTHER; note = uracil
  modified_base 20: mod_base = OTHER; note = uracil
  source 1..20: mol_type = other DNA
ggccaaacctcggcttacct

SEQ ID NO: 70 - DNA, 20 bp, synthetic construct
  misc_feature 1..20: note = Synthetic oligonucleotide
  modified_base 15: mod_base = OTHER; note = uracil
  modified_base 20: mod_base = OTHER; note = uracil
  source 1..20: mol_type = other DNA
ggccaaacctcggcttacct

SEQ ID NO: 71 - DNA, 20 bp, synthetic construct
  misc_feature 1..20: note = Synthetic oligonucleotide
  modified_base 16: mod_base = OTHER; note = uracil
  modified_base 20: mod_base = OTHER; note = uracil
  source 1..20: mol_type = other DNA
ggccaaacctcggcttacct

SEQ ID NO: 72 - DNA, 20 bp, synthetic construct
  misc_feature 1..20: note = Synthetic oligonucleotide
  modified_base 10: mod_base = OTHER; note = uracil
  modified_base 20: mod_base = OTHER; note = uracil
  source 1..20: mol_type = other DNA
ggccaaacctcggcttacct

SEQ ID NO: 73 - DNA, 20 bp, synthetic construct
  misc_feature 1..20: note = Synthetic oligonucleotide
  modified_base 10: mod_base = OTHER; note = uracil
  modified_base 15: mod_base = OTHER; note = uracil
  modified_base 20: mod_base = OTHER; note = uracil
  source 1..20: mol_type = other DNA
ggccaaacctcggcttacct

SEQ ID NO: 74 - RNA, 20 nt, synthetic construct
  misc_feature 1..20: note = Description of Artificial Sequence: Synthetic oligonucleotide
  source 1..20: mol_type = other RNA
agaaatgccatcttccttga

SEQ ID NO: 75 - RNA, 30 nt, synthetic construct
  misc_feature 1..30: note = Description of Artificial Sequence: Synthetic oligonucleotide
  source 1..30: mol_type = other RNA
ctccaacatcaaggaagatggcatttctag

SEQ ID NO: 76 - RNA, 25 nt, synthetic construct
  misc_feature 1..25: note = Description of Artificial Sequence: Synthetic oligonucleotide
  source 1..25: mol_type = other RNA
accagagtaacagtctgagtaggag

SEQ ID NO: 77 - RNA, 25 nt, synthetic construct
  misc_feature 1..25: note = Description of Artificial Sequence: Synthetic oligonucleotide
  source 1..25: mol_type = other RNA
caccagagtaacagtctgagtagga

SEQ ID NO: 78 - RNA, 25 nt, synthetic construct
  misc_feature 1..25: note = Description of Artificial Sequence: Synthetic oligonucleotide
  source 1..25: mol_type = other RNA
tcaccagagtaacagtctgagtagg

SEQ ID NO: 79 - RNA, 25 nt, synthetic construct
  misc_feature 1..25: note = Description of Artificial Sequence: Synthetic oligonucleotide
  source 1..25: mol_type = other RNA
gtcaccagagtaacagtctgagtag

SEQ ID NO: 80 - RNA, 25 nt, synthetic construct
  misc_feature 1..25: note = Description of Artificial Sequence: Synthetic oligonucleotide
  source 1..25: mol_type = other RNA
gttgtgtcaccagagtaacagtctg

SEQ ID NO: 81 - RNA, 25 nt, synthetic construct
  misc_feature 1..25: note = Description of Artificial Sequence: Synthetic oligonucleotide
  source 1..25: mol_type = other RNA
ggttgtgtcaccagagtaacagtct

SEQ ID NO: 82 - RNA, 25 nt, synthetic construct
  misc_feature 1..25: note = Description of Artificial Sequence: Synthetic oligonucleotide
  source 1..25: mol_type = other RNA
aggttgtgtcaccagagtaacagtc

SEQ ID NO: 83 - RNA, 25 nt, synthetic construct
  misc_feature 1..25: note = Description of Artificial Sequence: Synthetic oligonucleotide
  source 1..25: mol_type = other RNA
caggttgtgtcaccagagtaacagt

SEQ ID NO: 84 - RNA, 25 nt, synthetic construct
  misc_feature 1..25: note = Description of Artificial Sequence: Synthetic oligonucleotide
  source 1..25: mol_type = other RNA
acaggttgtgtcaccagagtaacag

SEQ ID NO: 85 - RNA, 25 nt, synthetic construct
  misc_feature 1..25: note = Description of Artificial Sequence: Synthetic oligonucleotide
  source 1..25: mol_type = other RNA
ccacaggttgtgtcaccagagtaac

SEQ ID NO: 86 - RNA, 25 nt, synthetic construct
  misc_feature 1..25: note = Description of Artificial Sequence: Synthetic oligonucleotide
  source 1..25: mol_type = other RNA
accacaggttgtgtcaccagagtaa

SEQ ID NO: 87 - RNA, 25 nt, synthetic construct
  misc_feature 1..25: note = Description of Artificial Sequence: Synthetic oligonucleotide
  source 1..25: mol_type = other RNA
aaccacaggttgtgtcaccagagta

SEQ ID NO: 88 - RNA, 25 nt, synthetic construct
  misc_feature 1..25: note = Description of Artificial Sequence: Synthetic oligonucleotide
  source 1..25: mol_type = other RNA
taaccacaggttgtgtcaccagagt

SEQ ID NO: 89 - RNA, 25 nt, synthetic construct
  misc_feature 1..25: note = Description of Artificial Sequence: Synthetic oligonucleotide
  source 1..25: mol_type = other RNA
gtaaccacaggttgtgtcaccagag

SEQ ID NO: 90 - RNA, 25 nt, synthetic construct
  misc_feature 1..25: note = Description of Artificial Sequence: Synthetic oligonucleotide
  source 1..25: mol_type = other RNA
agtaaccacaggttgtgtcaccaga

SEQ ID NO: 91 - RNA, 25 nt, synthetic construct
  misc_feature 1..25: note = Description of Artificial Sequence: Synthetic oligonucleotide
  source 1..25: mol_type = other RNA
tagtaaccacaggttgtgtcaccag

SEQ ID NO: 92 - RNA, 25 nt, synthetic construct
  misc_feature 1..25: note = Description of Artificial Sequence: Synthetic oligonucleotide
  source 1..25: mol_type = other RNA
ttagtaaccacaggttgtgtcacca

SEQ ID NO: 93 - RNA, 25 nt, synthetic construct
  misc_feature 1..25: note = Description of Artificial Sequence: Synthetic oligonucleotide
  source 1..25: mol_type = other RNA
cttagtaaccacaggttgtgtcacc

SEQ ID NO: 94 - RNA, 25 nt, synthetic construct
  misc_feature 1..25: note = Description of Artificial Sequence: Synthetic oligonucleotide
  source 1..25: mol_type = other RNA
ccttagtaaccacaggttgtgtcac

SEQ ID NO: 95 - RNA, 25 nt, synthetic construct
  misc_feature 1..25: note = Description of Artificial Sequence: Synthetic oligonucleotide
  source 1..25: mol_type = other RNA
tccttagtaaccacaggttgtgtca

SEQ ID NO: 96 - RNA, 25 nt, synthetic construct
  misc_feature 1..25: note = Description of Artificial Sequence: Synthetic oligonucleotide
  source 1..25: mol_type = other RNA
gtttccttagtaaccacaggttgtg

SEQ ID NO: 97 - RNA, 25 nt, synthetic construct
  misc_feature 1..25: note = Description of Artificial Sequence: Synthetic oligonucleotide
  source 1..25: mol_type = other RNA
agtttccttagtaaccacaggttgt

SEQ ID NO: 98 - RNA, 25 nt, synthetic construct
  misc_feature 1..25: note = Description of Artificial Sequence: Synthetic oligonucleotide
  source 1..25: mol_type = other RNA
cagtttccttagtaaccacaggttg

SEQ ID NO: 99 - RNA, 25 nt, synthetic construct
  misc_feature 1..25: note = Description of Artificial Sequence: Synthetic oligonucleotide
  source 1..25: mol_type = other RNA
gcagtttccttagtaaccacaggtt

SEQ ID NO: 100 - RNA, 25 nt, synthetic construct
  misc_feature 1..25: note = Description of Artificial Sequence: Synthetic oligonucleotide
  source 1..25: mol_type = other RNA
ggcagtttccttagtaaccacaggt

SEQ ID NO: 101 - RNA, 25 nt, synthetic construct
  misc_feature 1..25: note = Description of Artificial Sequence: Synthetic oligonucleotide
  source 1..25: mol_type = other RNA
tggcagtttccttagtaaccacagg

SEQ ID NO: 102 - RNA, 25 nt, synthetic construct
  misc_feature 1..25: note = Description of Artificial Sequence: Synthetic oligonucleotide
  source 1..25: mol_type = other RNA
atggcagtttccttagtaaccacag

SEQ ID NO: 103 - RNA, 25 nt, synthetic construct
  misc_feature 1..25: note = Description of Artificial Sequence: Synthetic oligonucleotide
  source 1..25: mol_type = other RNA
agatggcagtttccttagtaaccac

SEQ ID NO: 104 - RNA, 25 nt, synthetic construct
  misc_feature 1..25: note = Description of Artificial Sequence: Synthetic oligonucleotide
  source 1..25: mol_type = other RNA
gagatggcagtttccttagtaacca

SEQ ID NO: 105 - RNA, 25 nt, synthetic construct
  misc_feature 1..25: note = Description of Artificial Sequence: Synthetic oligonucleotide
  source 1..25: mol_type = other RNA
ggagatggcagtttccttagtaacc

SEQ ID NO: 106 - RNA, 25 nt, synthetic construct
  misc_feature 1..25: note = Description of Artificial Sequence: Synthetic oligonucleotide
  source 1..25: mol_type = other RNA
tggagatggcagtttccttagtaac

SEQ ID NO: 107 - RNA, 25 nt, synthetic construct
  misc_feature 1..25: note = Description of Artificial Sequence: Synthetic oligonucleotide
  source 1..25: mol_type = other RNA
ttggagatggcagtttccttagtaa

SEQ ID NO: 108 - RNA, 25 nt, synthetic construct
  misc_feature 1..25: note = Description of Artificial Sequence: Synthetic oligonucleotide
  source 1..25: mol_type = other RNA
tttggagatggcagtttccttagta

SEQ ID NO: 109 - RNA, 25 nt, synthetic construct
  misc_feature 1..25: note = Description of Artificial Sequence: Synthetic oligonucleotide
  source 1..25: mol_type = other RNA
agtttggagatggcagtttccttag

SEQ ID NO: 110 - RNA, 25 nt, synthetic construct
  misc_feature 1..25: note = Description of Artificial Sequence: Synthetic oligonucleotide
  source 1..25: mol_type = other RNA
tagtttggagatggcagtttcctta

SEQ ID NO: 111 - RNA, 25 nt, synthetic construct
  misc_feature 1..25: note = Description of Artificial Sequence: Synthetic oligonucleotide
  source 1..25: mol_type = other RNA
ctagtttggagatggcagtttcctt

SEQ ID NO: 112 - RNA, 25 nt, synthetic construct
  misc_feature 1..25: note = Description of Artificial Sequence: Synthetic oligonucleotide
  source 1..25: mol_type = other RNA
tctagtttggagatggcagtttcct

SEQ ID NO: 113 - RNA, 25 nt, synthetic construct
  misc_feature 1..25: note = Description of Artificial Sequence: Synthetic oligonucleotide
  source 1..25: mol_type = other RNA
ttctagtttggagatggcagtttcc

SEQ ID NO: 114 - RNA, 25 nt, synthetic construct
  misc_feature 1..25: note = Description of Artificial Sequence: Synthetic oligonucleotide
  source 1..25: mol_type = other RNA
catttctagtttggagatggcagtt

SEQ ID NO: 115 - RNA, 25 nt, synthetic construct
  misc_feature 1..25: note = Description of Artificial Sequence: Synthetic oligonucleotide
  source 1..25: mol_type = other RNA
gcatttctagtttggagatggcagt

SEQ ID NO: 116 - RNA, 25 nt, synthetic construct
  misc_feature 1..25: note = Description of Artificial Sequence: Synthetic oligonucleotide
  source 1..25: mol_type = other RNA
atggcatttctagtttggagatggc

SEQ ID NO: 117 - RNA, 25 nt, synthetic construct
  misc_feature 1..25: note = Description of Artificial Sequence: Synthetic oligonucleotide
  source 1..25: mol_type = other RNA
gaagatggcatttctagtttggaga

SEQ ID NO: 118 - RNA, 25 nt, synthetic construct
  misc_feature 1..25: note = Description of Artificial Sequence: Synthetic oligonucleotide
  source 1..25: mol_type = other RNA
aggaagatggcatttctagtttgga

SEQ ID NO: 119 - RNA, 25 nt, synthetic construct
  misc_feature 1..25: note = Description of Artificial Sequence: Synthetic oligonucleotide
  source 1..25: mol_type = other RNA
aaggaagatggcatttctagtttgg

SEQ ID NO: 120 - RNA, 25 nt, synthetic construct
  misc_feature 1..25: note = Description of Artificial Sequence: Synthetic oligonucleotide
  source 1..25: mol_type = other RNA
caaggaagatggcatttctagtttg

SEQ ID NO: 121 - RNA, 25 nt, synthetic construct
  misc_feature 1..25: note = Description of Artificial Sequence: Synthetic oligonucleotide
  source 1..25: mol_type = other RNA
catcaaggaagatggcatttctagt

SEQ ID NO: 122 - RNA, 25 nt, synthetic construct
  misc_feature 1..25: note = Description of Artificial Sequence: Synthetic oligonucleotide
  source 1..25: mol_type = other RNA
acatcaaggaagatggcatttctag

SEQ ID NO: 123 - RNA, 25 nt, synthetic construct
  misc_feature 1..25: note = Description of Artificial Sequence: Synthetic oligonucleotide
  source 1..25: mol_type = other RNA
aacatcaaggaagatggcatttcta

SEQ ID NO: 124 - RNA, 25 nt, synthetic construct
  misc_feature 1..25: note = Description of Artificial Sequence: Synthetic oligonucleotide
  source 1..25: mol_type = other RNA
caacatcaaggaagatggcatttct

SEQ ID NO: 125 - RNA, 25 nt, synthetic construct
  misc_feature 1..25: note = Description of Artificial Sequence: Synthetic oligonucleotide
  source 1..25: mol_type = other RNA
ctccaacatcaaggaagatggcatt

SEQ ID NO: 126 - RNA, 25 nt, synthetic construct
  misc_feature 1..25: note = Description of Artificial Sequence: Synthetic oligonucleotide
  source 1..25: mol_type = other RNA
acctccaacatcaaggaagatggca

SEQ ID NO: 127 - RNA, 25 nt, synthetic construct
  misc_feature 1..25: note = Description of Artificial Sequence: Synthetic oligonucleotide
  source 1..25: mol_type = other RNA
gtacctccaacatcaaggaagatgg

SEQ ID NO: 128 - RNA, 25 nt, synthetic construct
  misc_feature 1..25: note = Description of Artificial Sequence: Synthetic oligonucleotide
  source 1..25: mol_type = other RNA
aggtacctccaacatcaaggaagat

SEQ ID NO: 129 - RNA, 25 nt, synthetic construct
  misc_feature 1..25: note = Description of Artificial Sequence: Synthetic oligonucleotide
  source 1..25: mol_type = other RNA
agagcaggtacctccaacatcaagg

SEQ ID NO: 130 - RNA, 25 nt, synthetic construct
  misc_feature 1..25: note = Description of Artificial Sequence: Synthetic oligonucleotide
  source 1..25: mol_type = other RNA
cagagcaggtacctccaacatcaag

SEQ ID NO: 131 - RNA, 25 nt, synthetic construct
  misc_feature 1..25: note = Description of Artificial Sequence: Synthetic oligonucleotide
  source 1..25: mol_type = other RNA
ctgccagagcaggtacctccaacat

SEQ ID NO: 132 - RNA, 25 nt, synthetic construct
  misc_feature 1..25: note = Description of Artificial Sequence: Synthetic oligonucleotide
  source 1..25: mol_type = other RNA
tctgccagagcaggtacctccaaca

SEQ ID NO: 133 - RNA, 25 nt, synthetic construct
  misc_feature 1..25: note = Description of Artificial Sequence: Synthetic oligonucleotide
  source 1..25: mol_type = other RNA
atctgccagagcaggtacctccaac

SEQ ID NO: 134 - RNA, 25 nt, synthetic construct
  misc_feature 1..25: note = Description of Artificial Sequence: Synthetic oligonucleotide
  source 1..25: mol_type = other RNA
aatctgccagagcaggtacctccaa

SEQ ID NO: 135 - RNA, 25 nt, synthetic construct
  misc_feature 1..25: note = Description of Artificial Sequence: Synthetic oligonucleotide
  source 1..25: mol_type = other RNA
aaatctgccagagcaggtacctcca

SEQ ID NO: 136 - RNA, 25 nt, synthetic construct
  misc_feature 1..25: note = Description of Artificial Sequence: Synthetic oligonucleotide
  source 1..25: mol_type = other RNA
gaaatctgccagagcaggtacctcc

SEQ ID NO: 137 - RNA, 25 nt, synthetic construct
  misc_feature 1..25: note = Description of Artificial Sequence: Synthetic oligonucleotide
  source 1..25: mol_type = other RNA
tgaaatctgccagagcaggtacctc

SEQ ID NO: 138 - RNA, 25 nt, synthetic construct
  misc_feature 1..25: note = Description of Artificial Sequence: Synthetic oligonucleotide
  source 1..25: mol_type = other RNA
ttgaaatctgccagagcaggtacct

SEQ ID NO: 139 - RNA, 25 nt, synthetic construct
  misc_feature 1..25: note = Description of Artificial Sequence: Synthetic oligonucleotide
  source 1..25: mol_type = other RNA
cccggttgaaatctgccagagcagg

SEQ ID NO: 140 - RNA, 25 nt, synthetic construct
  misc_feature 1..25: note = Description of Artificial Sequence: Synthetic oligonucleotide
  source 1..25: mol_type = other RNA
ccaagcccggttgaaatctgccaga

SEQ ID NO: 141 - RNA, 25 nt, synthetic construct
  misc_feature 1..25: note = Description of Artificial Sequence: Synthetic oligonucleotide
  source 1..25: mol_type = other RNA
tccaagcccggttgaaatctgccag

SEQ ID NO: 142 - RNA, 25 nt, synthetic construct
  misc_feature 1..25: note = Description of Artificial Sequence: Synthetic oligonucleotide
  source 1..25: mol_type = other RNA
gtccaagcccggttgaaatctgcca

SEQ ID NO: 143 - RNA, 25 nt, synthetic construct
  misc_feature 1..25: note = Description of Artificial Sequence: Synthetic oligonucleotide
  source 1..25: mol_type = other RNA
tctgtccaagcccggttgaaatctg

SEQ ID NO: 144 - RNA, 25 nt, synthetic construct
  misc_feature 1..25: note = Description of Artificial Sequence: Synthetic oligonucleotide
  source 1..25: mol_type = other RNA
ttctgtccaagcccggttgaaatct

SEQ ID NO: 145 - RNA, 25 nt, synthetic construct
  misc_feature 1..25: note = Description of Artificial Sequence: Synthetic oligonucleotide
  source 1..25: mol_type = other RNA
gttctgtccaagcccggttgaaatc

SEQ ID NO: 146 - RNA, 25 nt, synthetic construct
  misc_feature 1..25: note = Description of Artificial Sequence: Synthetic oligonucleotide
  source 1..25: mol_type = other RNA
agttctgtccaagcccggttgaaat

SEQ ID NO: 147 - RNA, 25 nt, synthetic construct
  misc_feature 1..25: note = Description of Artificial Sequence: Synthetic oligonucleotide
  source 1..25: mol_type = other RNA
aagttctgtccaagcccggttgaaa

SEQ ID NO: 148 - RNA, 25 nt, synthetic construct
  misc_feature 1..25: note = Description of Artificial Sequence: Synthetic oligonucleotide
  source 1..25: mol_type = other RNA
taagttctgtccaagcccggttgaa

SEQ ID NO: 149 - RNA, 25 nt, synthetic construct
  misc_feature 1..25: note = Description of Artificial Sequence: Synthetic oligonucleotide
  source 1..25: mol_type = other RNA
gtaagttctgtccaagcccggttga

SEQ ID NO: 150 - RNA, 25 nt, synthetic construct
  misc_feature 1..25: note = Description of Artificial Sequence: Synthetic oligonucleotide
  source 1..25: mol_type = other RNA
ggtaagttctgtccaagcccggttg

SEQ ID NO: 151 - RNA, 25 nt, synthetic construct
  misc_feature 1..25: note = Description of Artificial Sequence: Synthetic oligonucleotide
  source 1..25: mol_type = other RNA
cggtaagttctgtccaagcccggtt

SEQ ID NO: 152 - RNA, 25 nt, synthetic construct
  misc_feature 1..25: note = Description of Artificial Sequence: Synthetic oligonucleotide
  source 1..25: mol_type = other RNA
tcggtaagttctgtccaagcccggt

SEQ ID NO: 153 - RNA, 25 nt, synthetic construct
  misc_feature 1..25: note = Description of Artificial Sequence: Synthetic oligonucleotide
  source 1..25: mol_type = other RNA
gtcggtaagttctgtccaagcccgg

SEQ ID NO: 154 - RNA, 25 nt, synthetic construct
  misc_feature 1..25: note = Description of Artificial Sequence: Synthetic oligonucleotide
  source 1..25: mol_type = other RNA
agtcggtaagttctgtccaagcccg

SEQ ID NO: 155 - RNA, 25 nt, synthetic construct
  misc_feature 1..25: note = Description of Artificial Sequence: Synthetic oligonucleotide
  source 1..25: mol_type = other RNA
cagtcggtaagttctgtccaagccc

SEQ ID NO: 156 - RNA, 25 nt, synthetic construct
  misc_feature 1..25: note = Description of Artificial Sequence: Synthetic oligonucleotide
  source 1..25: mol_type = other RNA
aaagccagtcggtaagttctgtcca

SEQ ID NO: 157 - RNA, 25 nt, synthetic construct
  misc_feature 1..25: note = Description of Artificial Sequence: Synthetic oligonucleotide
  source 1..25: mol_type = other RNA
gaaagccagtcggtaagttctgtcc

SEQ ID NO: 158 - RNA, 25 nt, synthetic construct
  misc_feature 1..25: note = Description of Artificial Sequence: Synthetic oligonucleotide
  source 1..25: mol_type = other RNA
gtcacccaccatcaccctctgtgat

SEQ ID NO: 159 - RNA, 25 nt, synthetic construct
  misc_feature 1..25: note = Description of Artificial Sequence: Synthetic oligonucleotide
  source 1..25: mol_type = other RNA
ggtcacccaccatcaccctctgtga

SEQ ID NO: 160 - RNA, 25 nt, synthetic construct
  misc_feature 1..25: note = Description of Artificial Sequence: Synthetic oligonucleotide
  source 1..25: mol_type = other RNA
aaggtcacccaccatcaccctctgt

SEQ ID NO: 161 - RNA, 25 nt, synthetic construct
  misc_feature 1..25: note = Description of Artificial Sequence: Synthetic oligonucleotide
  source 1..25: mol_type = other RNA
caaggtcacccaccatcaccctctg

SEQ ID NO: 162 - RNA, 25 nt, synthetic construct
  misc_feature 1..25: note = Description of Artificial Sequence: Synthetic oligonucleotide
  source 1..25: mol_type = other RNA
tcaaggtcacccaccatcaccctct

SEQ ID NO: 163 - RNA, 25 nt, synthetic construct
  misc_feature 1..25: note = Description of Artificial Sequence: Synthetic oligonucleotide
  source 1..25: mol_type = other RNA
ctcaaggtcacccaccatcaccctc

SEQ ID NO: 164 - RNA, 25 nt, synthetic construct
  misc_feature 1..25: note = Description of Artificial Sequence: Synthetic oligonucleotide
  source 1..25: mol_type = other RNA
cttgatcaagcagagaaagccagtc

SEQ ID NO: 165 - RNA, 25 nt, synthetic construct
  misc_feature 1..25: note = Description of Artificial Sequence: Synthetic oligonucleotide
  source 1..25: mol_type = other RNA
ataacttgatcaagcagagaaagcc

SEQ ID NO: 166 - RNA, 20 nt, synthetic construct
  misc_feature 1..20: note = Description of Artificial Sequence: Synthetic oligonucleotide
  source 1..20: mol_type = other RNA
agtaacagtctgagtaggag

SEQ ID NO: 167 - RNA, 20 nt, synthetic construct
  misc_feature 1..20: note = Description of Artificial Sequence: Synthetic oligonucleotide
  source 1..20: mol_type = other RNA
gagtaacagtctgagtagga

SEQ ID NO: 168 - RNA, 20 nt, synthetic construct
  misc_feature 1..20: note = Description of Artificial Sequence: Synthetic oligonucleotide
  source 1..20: mol_type = other RNA
agagtaacagtctgagtagg

SEQ ID NO: 169 - RNA, 20 nt, synthetic construct
  misc_feature 1..20: note = Description of Artificial Sequence: Synthetic oligonucleotide
  source 1..20: mol_type = other RNA
cagagtaacagtctgagtag

SEQ ID NO: 170 - RNA, 20 nt, synthetic construct
  misc_feature 1..20: note = Description of Artificial Sequence: Synthetic oligonucleotide
  source 1..20: mol_type = other RNA
gtcaccagagtaacagtctg

SEQ ID NO: 171 - RNA, 20 nt, synthetic construct
  misc_feature 1..20: note = Description of Artificial Sequence: Synthetic oligonucleotide
  source 1..20: mol_type = other RNA
tgtcaccagagtaacagtct

SEQ ID NO: 172 - RNA, 20 nt, synthetic construct
  misc_feature 1..20: note = Description of Artificial Sequence: Synthetic oligonucleotide
  source 1..20: mol_type = other RNA
gtgtcaccagagtaacagtc

SEQ ID NO: 173 - RNA, 20 nt, synthetic construct
  misc_feature 1..20: note = Description of Artificial Sequence: Synthetic oligonucleotide
  source 1..20: mol_type = other RNA
tgtgtcaccagagtaacagt

SEQ ID NO: 174 - RNA, 20 nt, synthetic construct
  misc_feature 1..20: note = Description of Artificial Sequence: Synthetic oligonucleotide
  source 1..20: mol_type = other RNA
ttgtgtcaccagagtaacag

SEQ ID NO: 175 - RNA, 20 nt, synthetic construct
  misc_feature 1..20: note = Description of Artificial Sequence: Synthetic oligonucleotide
  source 1..20: mol_type = other RNA
ggttgtgtcaccagagtaac

SEQ ID NO: 176 - RNA, 20 nt, synthetic construct
  misc_feature 1..20: note = Description of Artificial Sequence: Synthetic oligonucleotide
  source 1..20: mol_type = other RNA
aggttgtgtcaccagagtaa

SEQ ID NO: 177 - RNA, 20 nt, synthetic construct
  misc_feature 1..20: note = Description of Artificial Sequence: Synthetic oligonucleotide
  source 1..20: mol_type = other RNA
caggttgtgtcaccagagta

SEQ ID NO: 178 - RNA, 20 nt, synthetic construct
  misc_feature 1..20: note = Description of Artificial Sequence: Synthetic oligonucleotide
  source 1..20: mol_type = other RNA
acaggttgtgtcaccagagt

SEQ ID NO: 179 - RNA, 20 nt, synthetic construct
  misc_feature 1..20: note = Description of Artificial Sequence: Synthetic oligonucleotide
  source 1..20: mol_type = other RNA
cacaggttgtgtcaccagag

SEQ ID NO: 180 - RNA, 20 nt, synthetic construct
  misc_feature 1..20: note = Description of Artificial Sequence: Synthetic oligonucleotide
  source 1..20: mol_type = other RNA
ccacaggttgtgtcaccaga

SEQ ID NO: 181 - RNA, 20 nt, synthetic construct
  misc_feature 1..20: note = Description of Artificial Sequence: Synthetic oligonucleotide
  source 1..20: mol_type = other RNA
accacaggttgtgtcaccag

SEQ ID NO: 182 - RNA, 20 nt, synthetic construct
  misc_feature 1..20: note = Description of Artificial Sequence: Synthetic oligonucleotide
  source 1..20: mol_type = other RNA
aaccacaggttgtgtcacca

SEQ ID NO: 183 - RNA, 20 nt, synthetic construct
  misc_feature 1..20: note = Description of Artificial Sequence: Synthetic oligonucleotide
  source 1..20: mol_type = other RNA
taaccacaggttgtgtcacc

SEQ ID NO: 184 - RNA, 20 nt, synthetic construct
  misc_feature 1..20: note = Description of Artificial Sequence: Synthetic oligonucleotide
  source 1..20: mol_type = other RNA
gtaaccacaggttgtgtcac

SEQ ID NO: 185 - RNA, 20 nt, synthetic construct
  misc_feature 1..20: note = Description of Artificial Sequence: Synthetic oligonucleotide
  source 1..20: mol_type = other RNA
agtaaccacaggttgtgtca

SEQ ID NO: 186 - RNA, 20 nt, synthetic construct
  misc_feature 1..20: note = Description of Artificial Sequence: Synthetic oligonucleotide
  source 1..20: mol_type = other RNA
cttagtaaccacaggttgtg

SEQ ID NO: 187 - RNA, 20 nt, synthetic construct
  misc_feature 1..20: note = Description of Artificial Sequence: Synthetic oligonucleotide
  source 1..20: mol_type = other RNA
ccttagtaaccacaggttgt

SEQ ID NO: 188 - RNA, 20 nt, synthetic construct
  misc_feature 1..20: note = Description of Artificial Sequence: Synthetic oligonucleotide
  source 1..20: mol_type = other RNA
tccttagtaaccacaggttg

SEQ ID NO: 189 - RNA, 20 nt, synthetic construct
  misc_feature 1..20: note = Description of Artificial Sequence: Synthetic oligonucleotide
  source 1..20: mol_type = other RNA
ttccttagtaaccacaggtt

SEQ ID NO: 190 - RNA, 20 nt, synthetic construct
  misc_feature 1..20: note = Description of Artificial Sequence: Synthetic oligonucleotide
  source 1..20: mol_type = other RNA
tttccttagtaaccacaggt

SEQ ID NO: 191 - RNA, 20 nt, synthetic construct
  misc_feature 1..20: note = Description of Artificial Sequence: Synthetic oligonucleotide
  source 1..20: mol_type = other RNA
gtttccttagtaaccacagg

SEQ ID NO: 192 - RNA, 20 nt, synthetic construct
  misc_feature 1..20: note = Description of Artificial Sequence: Synthetic oligonucleotide
  source 1..20: mol_type = other RNA
agtttccttagtaaccacag

SEQ ID NO: 193 - RNA, 20 nt, synthetic construct
  misc_feature 1..20: note = Description of Artificial Sequence: Synthetic oligonucleotide
  source 1..20: mol_type = other RNA
gcagtttccttagtaaccac

SEQ ID NO: 194 - RNA, 20 nt, synthetic construct
  misc_feature 1..20: note = Description of Artificial Sequence: Synthetic oligonucleotide
  source 1..20: mol_type = other RNA
ggcagtttccttagtaacca

SEQ ID NO: 195 - RNA, 20 nt, synthetic construct
  misc_feature 1..20: note = Description of Artificial Sequence: Synthetic oligonucleotide
  source 1..20: mol_type = other RNA
tggcagtttccttagtaacc

SEQ ID NO: 196 - RNA, 20 nt, synthetic construct
  misc_feature 1..20: note = Description of Artificial Sequence: Synthetic oligonucleotide
  source 1..20: mol_type = other RNA
atggcagtttccttagtaac

SEQ ID NO: 197 - RNA, 20 nt, synthetic construct
  misc_feature 1..20: note = Description of Artificial Sequence: Synthetic oligonucleotide
  source 1..20: mol_type = other RNA
gatggcagtttccttagtaa

SEQ ID NO: 198 - RNA, 20 nt, synthetic construct
  misc_feature 1..20: note = Description of Artificial Sequence: Synthetic oligonucleotide
  source 1..20: mol_type = other RNA
agatggcagtttccttagta

SEQ ID NO: 199 - RNA, 20 nt, synthetic construct
  misc_feature 1..20: note = Description of Artificial Sequence: Synthetic oligonucleotide
  source 1..20: mol_type = other RNA
ggagatggcagtttccttag

SEQ ID NO: 200 - RNA, 20 nt, synthetic construct
  misc_feature 1..20: note = Description of Artificial Sequence: Synthetic oligonucleotide
  source 1..20: mol_type = other RNA
tggagatggcagtttcctta

SEQ ID NO: 201 - RNA, 20 nt, synthetic construct
  misc_feature 1..20: note = Description of Artificial Sequence: Synthetic oligonucleotide
  source 1..20: mol_type = other RNA
ttggagatggcagtttcctt

SEQ ID NO: 202 - RNA, 20 nt, synthetic construct
  misc_feature 1..20: note = Description of Artificial Sequence: Synthetic oligonucleotide
  source 1..20: mol_type = other RNA
tttggagatggcagtttcct

SEQ ID NO: 203 - RNA, 20 nt, synthetic construct
  misc_feature 1..20: note = Description of Artificial Sequence: Synthetic oligonucleotide
  source 1..20: mol_type = other RNA
gtttggagatggcagtttcc

SEQ ID NO: 204 - RNA, 20 nt, synthetic construct
  misc_feature 1..20: note = Description of Artificial Sequence: Synthetic oligonucleotide
  source 1..20: mol_type = other RNA
ctagtttggagatggcagtt

SEQ ID NO: 205 - RNA, 20 nt, synthetic construct
  misc_feature 1..20: note = Description of Artificial Sequence: Synthetic oligonucleotide
  source 1..20: mol_type = other RNA
tctagtttggagatggcagt

SEQ ID NO: 206 - RNA, 20 nt, synthetic construct
  misc_feature 1..20: note = Description of Artificial Sequence: Synthetic oligonucleotide
  source 1..20: mol_type = other RNA
atttctagtttggagatggc

SEQ ID NO: 207 - RNA, 20 nt, synthetic construct
  misc_feature 1..20: note = Description of Artificial Sequence: Synthetic oligonucleotide
  source 1..20: mol_type = other RNA
tggcatttctagtttggaga

SEQ ID NO: 208 - RNA, 20 nt, synthetic construct
  misc_feature 1..20: note = Description of Artificial Sequence: Synthetic oligonucleotide
  source 1..20: mol_type = other RNA
gatggcatttctagtttgga

SEQ ID NO: 209 - RNA, 20 nt, synthetic construct
  misc_feature 1..20: note = Description of Artificial Sequence: Synthetic oligonucleotide
  source 1..20: mol_type = other RNA
agatggcatttctagtttgg

SEQ ID NO: 210 - RNA, 20 nt, synthetic construct
  misc_feature 1..20: note = Description of Artificial Sequence: Synthetic oligonucleotide
  source 1..20: mol_type = other RNA
aagatggcatttctagtttg

SEQ ID NO: 211 - RNA, 20 nt, synthetic construct
  misc_feature 1..20: note = Description of Artificial Sequence: Synthetic oligonucleotide
  source 1..20: mol_type = other RNA
aggaagatggcatttctagt

SEQ ID NO: 212 - RNA, 20 nt, synthetic construct
  misc_feature 1..20: note = Description of Artificial Sequence: Synthetic oligonucleotide
  source 1..20: mol_type = other RNA
aaggaagatggcatttctag

SEQ ID NO: 213 - RNA, 20 nt, synthetic construct
  misc_feature 1..20: note = Description of Artificial Sequence: Synthetic oligonucleotide
  source 1..20: mol_type = other RNA
caaggaagatggcatttcta

SEQ ID NO: 214 - RNA, 20 nt, synthetic construct
  misc_feature 1..20: note = Description of Artificial Sequence: Synthetic oligonucleotide
  source 1..20: mol_type = other RNA
acatcaaggaagatggcatt

SEQ ID NO: 215 - RNA, 20 nt, synthetic construct
  misc_feature 1..20: note = Description of Artificial Sequence: Synthetic oligonucleotide
  source 1..20: mol_type = other RNA
caacatcaaggaagatggca

SEQ ID NO: 216 - RNA, 20 nt, synthetic construct
  misc_feature 1..20: note = Description of Artificial Sequence: Synthetic oligonucleotide
  source 1..20: mol_type = other RNA
tccaacatcaaggaagatgg

SEQ ID NO: 217 - RNA, 20 nt, synthetic construct
  misc_feature 1..20: note = Description of Artificial Sequence: Synthetic oligonucleotide
  source 1..20: mol_type = other RNA
cctccaacatcaaggaagat

SEQ ID NO: 218 - RNA, 20 nt, synthetic construct
  misc_feature 1..20: note = Description of Artificial Sequence: Synthetic oligonucleotide
  source 1..20: mol_type = other RNA
aggtacctccaacatcaagg

SEQ ID NO: 219 - RNA, 20 nt, synthetic construct
  misc_feature 1..20: note = Description of Artificial Sequence: Synthetic oligonucleotide
  source 1..20: mol_type = other RNA
caggtacctccaacatcaag

SEQ ID NO: 220 - RNA, 20 nt, synthetic construct
  misc_feature 1..20: note = Description of Artificial Sequence: Synthetic oligonucleotide
  source 1..20: mol_type = other RNA
agagcaggtacctccaacat

SEQ ID NO: 221 - RNA, 20 nt, synthetic construct
  misc_feature 1..20: note = Description of Artificial Sequence: Synthetic oligonucleotide
  source 1..20: mol_type = other RNA
cagagcaggtacctccaaca

SEQ ID NO: 222 - RNA, 20 nt, synthetic construct
  misc_feature 1..20: note = Description of Artificial Sequence: Synthetic oligonucleotide
  source 1..20: mol_type = other RNA
ccagagcaggtacctccaac

SEQ ID NO: 223 - RNA, 20 nt, synthetic construct
  misc_feature 1..20: note = Description of Artificial Sequence: Synthetic oligonucleotide
  source 1..20: mol_type = other RNA
gccagagcaggtacctccaa

SEQ ID NO: 224 - RNA, 20 nt, synthetic construct
  misc_feature 1..20: note = Description of Artificial Sequence: Synthetic oligonucleotide
  source 1..20: mol_type = other RNA
tgccagagcaggtacctcca

SEQ ID NO: 225 - RNA, 20 nt, synthetic construct
  misc_feature 1..20: note = Description of Artificial Sequence: Synthetic oligonucleotide
  source 1..20: mol_type = other RNA
ctgccagagcaggtacctcc

SEQ ID NO: 226 - RNA, 20 nt, synthetic construct
  misc_feature 1..20: note = Description of Artificial Sequence: Synthetic oligonucleotide
  source 1..20: mol_type = other RNA
tctgccagagcaggtacctc

SEQ ID NO: 227 - RNA, 20 nt, synthetic construct
  misc_feature 1..20: note = Description of Artificial Sequence: Synthetic oligonucleotide
  source 1..20: mol_type = other RNA
atctgccagagcaggtacct

SEQ ID NO: 228 - RNA, 20 nt, synthetic construct
  misc_feature 1..20: note = Description of Artificial Sequence: Synthetic oligonucleotide
  source 1..20: mol_type = other RNA
ttgaaatctgccagagcagg

SEQ ID NO: 229 - RNA, 20 nt, synthetic construct
  misc_feature 1..20: note = Description of Artificial Sequence: Synthetic oligonucleotide
  source 1..20: mol_type = other RNA
cccggttgaaatctgccaga

SEQ ID NO: 230 - RNA, 20 nt, synthetic construct
  misc_feature 1..20: note = Description of Artificial Sequence: Synthetic oligonucleotide
  source 1..20: mol_type = other RNA
gcccggttgaaatctgccag

SEQ ID NO: 231 - RNA, 20 nt, synthetic construct
  misc_feature 1..20: note = Description of Artificial Sequence: Synthetic oligonucleotide
  source 1..20: mol_type = other RNA
agcccggttgaaatctgcca

SEQ ID NO: 232 - RNA, 20 nt, synthetic construct
  misc_feature 1..20: note = Description of Artificial Sequence: Synthetic oligonucleotide
  source 1..20: mol_type = other RNA
ccaagcccggttgaaatctg

SEQ ID NO: 233 - RNA, 20 nt, synthetic construct
  misc_feature 1..20: note = Description of Artificial Sequence: Synthetic oligonucleotide
  source 1..20: mol_type = other RNA
tccaagcccggttgaaatct

SEQ ID NO: 234 - RNA, 20 nt, synthetic construct
  misc_feature 1..20: note = Description of Artificial Sequence: Synthetic oligonucleotide
  source 1..20: mol_type = other RNA
gtccaagcccggttgaaatc

SEQ ID NO: 235 - RNA, 20 nt, synthetic construct
  misc_feature 1..20: note = Description of Artificial Sequence: Synthetic oligonucleotide
  source 1..20: mol_type = other RNA
tgtccaagcccggttgaaat

SEQ ID NO: 236 - RNA, 20 nt, synthetic construct
  misc_feature 1..20: note = Description of Artificial Sequence: Synthetic oligonucleotide
  source 1..20: mol_type = other RNA
ctgtccaagcccggttgaaa

SEQ ID NO: 237 - RNA, 20 nt, synthetic construct
  misc_feature 1..20: note = Description of Artificial Sequence: Synthetic oligonucleotide
  source 1..20: mol_type = other RNA
tctgtccaagcccggttgaa

SEQ ID NO: 238 - RNA, 20 nt, synthetic construct
  misc_feature 1..20: note = Description of Artificial Sequence: Synthetic oligonucleotide
  source 1..20: mol_type = other RNA
ttctgtccaagcccggttga

SEQ ID NO: 239 - RNA, 20 nt, synthetic construct
  misc_feature 1..20: note = Description of Artificial Sequence: Synthetic oligonucleotide
  source 1..20: mol_type = other RNA
gttctgtccaagcccggttg

SEQ ID NO: 240 - RNA, 20 nt, synthetic construct
  misc_feature 1..20: note = Description of Artificial Sequence: Synthetic oligonucleotide
  source 1..20: mol_type = other RNA
agttctgtccaagcccggtt

SEQ ID NO: 241 - RNA, 20 nt, synthetic construct
  misc_feature 1..20: note = Description of Artificial Sequence: Synthetic oligonucleotide
  source 1..20: mol_type = other RNA
aagttctgtccaagcccggt

SEQ ID NO: 242 - RNA, 20 nt, synthetic construct
  misc_feature 1..20: note = Description of Artificial Sequence: Synthetic oligonucleotide
  source 1..20: mol_type = other RNA
taagttctgtccaagcccgg

SEQ ID NO: 243 - RNA, 20 nt, synthetic construct
  misc_feature 1..20: note = Description of Artificial Sequence: Synthetic oligonucleotide
  source 1..20: mol_type = other RNA
gtaagttctgtccaagcccg

SEQ ID NO: 244 - RNA, 20 nt, synthetic construct
  misc_feature 1..20: note = Description of Artificial Sequence: Synthetic oligonucleotide
  source 1..20: mol_type = other RNA
ggtaagttctgtccaagccc

SEQ ID NO: 245 - RNA, 20 nt, synthetic construct
  misc_feature 1..20: note = Description of Artificial Sequence: Synthetic oligonucleotide
  source 1..20: mol_type = other RNA
cagtcggtaagttctgtcca

SEQ ID NO: 246 - RNA, 20 nt, synthetic construct
  misc_feature 1..20: note = Description of Artificial Sequence: Synthetic oligonucleotide
  source 1..20: mol_type = other RNA
ccagtcggtaagttctgtcc

SEQ ID NO: 247 - RNA, 20 nt, synthetic construct
  misc_feature 1..20: note = Description of Artificial Sequence: Synthetic oligonucleotide
  source 1..20: mol_type = other RNA
ccaccatcaccctctgtgat

SEQ ID NO: 248 - RNA, 20 nt, synthetic construct
  misc_feature 1..20: note = Description of Artificial Sequence: Synthetic oligonucleotide
  source 1..20: mol_type = other RNA
cccaccatcaccctctgtga

SEQ ID NO: 249 - RNA, 20 nt, synthetic construct
  misc_feature 1..20: note = Description of Artificial Sequence: Synthetic oligonucleotide
  source 1..20: mol_type = other RNA
cacccaccatcaccctctgt

SEQ ID NO: 250 - RNA, 20 nt, synthetic construct
  misc_feature 1..20: note = Description of Artificial Sequence: Synthetic oligonucleotide
  source 1..20: mol_type = other RNA
tcacccaccatcaccctctg

SEQ ID NO: 251 - RNA, 20 nt, synthetic construct
  misc_feature 1..20: note = Description of Artificial Sequence: Synthetic oligonucleotide
  source 1..20: mol_type = other RNA
gtcacccaccatcaccctct

SEQ ID NO: 252 - RNA, 20 nt, synthetic construct
  misc_feature 1..20: note = Description of Artificial Sequence: Synthetic oligonucleotide
  source 1..20: mol_type = other RNA
ggtcacccaccatcaccctc

SEQ ID NO: 253 - RNA, 20 nt, synthetic construct
  misc_feature 1..20: note = Description of Artificial Sequence: Synthetic oligonucleotide
  source 1..20: mol_type = other RNA
tcaagcagagaaagccagtc

SEQ ID NO: 254 - RNA, 20 nt, synthetic construct
  misc_feature 1..20: note = Description of Artificial Sequence: Synthetic oligonucleotide
  source 1..20: mol_type = other RNA
ttgatcaagcagagaaagcc

SEQ ID NO: 255 - RNA, 25 nt, synthetic construct
  misc_feature 1..25: note = Description of Artificial Sequence: Synthetic oligonucleotide
  source 1..25: mol_type = other RNA
caaagaagatggcatttctagtttg

SEQ ID NO: 256 - RNA, 20 nt, synthetic construct
  misc_feature 1..20: note = Description of Artificial Sequence: Synthetic oligonucleotide
  source 1..20: mol_type = other RNA
gcaaagaagatggcatttct

SEQ ID NO: 257 - RNA, 25 nt, synthetic construct
  misc_feature 1..25: note = Description of Artificial Sequence: Synthetic oligonucleotide
  source 1..25: mol_type = other RNA
ggccaaacctcggcttacctgaaat

SEQ ID NO: 258 - DNA, 20 bp, synthetic construct
  misc_feature 1..20: note = Synthetic oligonucleotide
  modified_base 1: mod_base = OTHER; note = uracil
  modified_base 16..18: mod_base = OTHER; note = uracil
  modified_base 20: mod_base = OTHER; note = uracil
  source 1..20: mol_type = other DNA
tcaaggaagatggcatttct

SEQ ID NO: 259 - RNA, 30 nt, synthetic construct
  misc_feature 1..30: note = Description of Artificial Sequence: Synthetic oligonucleotide
  source 1..30: mol_type = other RNA
gccaactgggagctggagcgcaccaaccag

SEQ ID NO: 260 - RNA, 20 nt, synthetic construct
  misc_feature 1..20: note = Description of Artificial Sequence: Synthetic oligonucleotide
  source 1..20: mol_type = other RNA
ccttccctgaaggttcctcc

SEQ ID NO: 261 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 262 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 263 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 264 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 265 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 266 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 267 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 268 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 269 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 270 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 271 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 272 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 273 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 274 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 275 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 276 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 277 - DNA, 20 bp, synthetic construct
  misc_feature 1..20: note = Description of Artificial Sequence: Synthetic oligonucleotide
  source 1..20: mol_type = other DNA
tcaaggaagatggcatttct

SEQ ID NO: 278 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 279 - DNA, 20 bp, synthetic construct
  misc_feature 1..20: note = Description of Artificial Sequence: Synthetic oligonucleotide
  source 1..20: mol_type = other DNA
tcaaggaagatggcatttct

SEQ ID NO: 280 - DNA, 20 bp, synthetic construct
  misc_feature 1..20: note = Description of Artificial Sequence: Synthetic oligonucleotide
  source 1..20: mol_type = other DNA
tcaaggaagatggcatttct

SEQ ID NO: 281 - DNA, 20 bp, synthetic construct
  misc_feature 1..20: note = Synthetic oligonucleotide
  modified_base 11: mod_base = OTHER; note = uracil
  source 1..20: mol_type = other DNA
tcaaggaagatggcatttct

SEQ ID NO: 282 - DNA, 20 bp, synthetic construct
  misc_feature 1..20: note = Synthetic oligonucleotide
  modified_base 1: mod_base = OTHER; note = uracil
  modified_base 17..18: mod_base = OTHER; note = uracil
  modified_base 20: mod_base = OTHER; note = uracil
  source 1..20: mol_type = other DNA
tcaaggaagatggcatttct

SEQ ID NO: 283 - DNA, 20 bp, synthetic construct
  misc_feature 1..20: note = Synthetic oligonucleotide
  modified_base 16: mod_base = OTHER; note = uracil
  modified_base 18: mod_base = OTHER; note = uracil
  modified_base 20: mod_base = OTHER; note = uracil
  source 1..20: mol_type = other DNA
tcaaggaagatggcatttct

SEQ ID NO: 284 - DNA, 20 bp, synthetic construct
  misc_feature 1..20: note = Synthetic oligonucleotide
  modified_base 1: mod_base = OTHER; note = uracil
  modified_base 11: mod_base = OTHER; note = uracil
  modified_base 17: mod_base = OTHER; note = uracil
  modified_base 20: mod_base = OTHER; note = uracil
  source 1..20: mol_type = other DNA
tcaaggaagatggcatttct

SEQ ID NO: 285 - DNA, 20 bp, synthetic construct
  misc_feature 1..20: note = Synthetic oligonucleotide
  modified_base 16..17: mod_base = OTHER; note = uracil
  modified_base 20: mod_base = OTHER; note = uracil
  source 1..20: mol_type = other DNA
tcaaggaagatggcatttct

SEQ ID NO: 286 - DNA, 20 bp, synthetic construct
  misc_feature 1..20: note = Synthetic oligonucleotide
  modified_base 11: mod_base = OTHER; note = uracil
  modified_base 16: mod_base = OTHER; note = uracil
  modified_base 20: mod_base = OTHER; note = uracil
  source 1..20: mol_type = other DNA
tcaaggaagatggcatttct

SEQ ID NO: 287 - DNA, 20 bp, synthetic construct
  misc_feature 1..20: note = Synthetic oligonucleotide
  modified_base 20: mod_base = OTHER; note = uracil
  source 1..20: mol_type = other DNA
tcaaggaagatggcatttct

SEQ ID NO: 288 - DNA, 20 bp, synthetic construct
  misc_feature 1..20: note = Synthetic oligonucleotide
  modified_base 16: mod_base = OTHER; note = uracil
  modified_base 20: mod_base = OTHER; note = uracil
  source 1..20: mol_type = other DNA
tcaaggaagatggcatttct

SEQ ID NO: 289 - DNA, 20 bp, synthetic construct
  misc_feature 1..20: note = Synthetic oligonucleotide
  modified_base 1: mod_base = OTHER; note = uracil
  modified_base 11: mod_base = OTHER; note = uracil
  modified_base 20: mod_base = OTHER; note = uracil
  source 1..20: mol_type = other DNA
tcaaggaagatggcatttct

SEQ ID NO: 290 - DNA, 20 bp, synthetic construct
  misc_feature 1..20: note = Synthetic oligonucleotide
  modified_base 20: mod_base = OTHER; note = uracil
  source 1..20: mol_type = other DNA
tcaaggaagatggcatttct

SEQ ID NO: 291 - DNA, 20 bp, synthetic construct
  misc_feature 1..20: note = Synthetic oligonucleotide
  modified_base 11: mod_base = OTHER; note = uracil
  source 1..20: mol_type = other DNA
tcaaggaagatggcatttct

SEQ ID NO: 292 - DNA, 20 bp, synthetic construct
  misc_feature 1..20: note = Synthetic oligonucleotide
  modified_base 1: mod_base = OTHER; note = uracil
  modified_base 17..18: mod_base = OTHER; note = uracil
  modified_base 20: mod_base = OTHER; note = uracil
  source 1..20: mol_type = other DNA
tcaaggaagatggcatttct

SEQ ID NO: 293 - DNA, 20 bp, synthetic construct
  misc_feature 1..20: note = Synthetic oligonucleotide
  modified_base 16: mod_base = OTHER; note = uracil
  modified_base 18: mod_base = OTHER; note = uracil
  modified_base 20: mod_base = OTHER; note = uracil
  source 1..20: mol_type = other DNA
tcaaggaagatggcatttct

SEQ ID NO: 294 - DNA, 20 bp, synthetic construct
  misc_feature 1..20: note = Synthetic oligonucleotide
  modified_base 1: mod_base = OTHER; note = uracil
  modified_base 11: mod_base = OTHER; note = uracil
  modified_base 17: mod_base = OTHER; note = uracil
  modified_base 20: mod_base = OTHER; note = uracil
  source 1..20: mol_type = other DNA
tcaaggaagatggcatttct

SEQ ID NO: 295 - DNA, 20 bp, synthetic construct
  misc_feature 1..20: note = Synthetic oligonucleotide
  modified_base 16..17: mod_base = OTHER; note = uracil
  modified_base 20: mod_base = OTHER; note = uracil
  source 1..20: mol_type = other DNA
tcaaggaagatggcatttct

SEQ ID NO: 296 - DNA, 20 bp, synthetic construct
  misc_feature 1..20: note = Synthetic oligonucleotide
  modified_base 11: mod_base = OTHER; note = uracil
  modified_base 16: mod_base = OTHER; note = uracil
  modified_base 20: mod_base = OTHER; note = uracil
  source 1..20: mol_type = other DNA
tcaaggaagatggcatttct

SEQ ID NO: 297 - DNA, 20 bp, synthetic construct
  misc_feature 1..20: note = Synthetic oligonucleotide
  modified_base 20: mod_base = OTHER; note = uracil
  source 1..20: mol_type = other DNA
tcaaggaagatggcatttct

SEQ ID NO: 298 - DNA, 20 bp, synthetic construct
  misc_feature 1..20: note = Synthetic oligonucleotide
  modified_base 16: mod_base = OTHER; note = uracil
  modified_base 20: mod_base = OTHER; note = uracil
  source 1..20: mol_type = other DNA
tcaaggaagatggcatttct

SEQ ID NO: 299 - DNA, 20 bp, synthetic construct
  misc_feature 1..20: note = Synthetic oligonucleotide
  modified_base 1: mod_base = OTHER; note = uracil
  modified_base 11: mod_base = OTHER; note = uracil
  modified_base 20: mod_base = OTHER; note = uracil
  source 1..20: mol_type = other DNA
tcaaggaagatggcatttct

SEQ ID NO: 300 - DNA, 20 bp, synthetic construct
  misc_feature 1..20: note = Synthetic oligonucleotide
  modified_base 20: mod_base = OTHER; note = uracil
  source 1..20: mol_type = other DNA
tcaaggaagatggcatttct

SEQ ID NO: 301 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 302 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 303 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 304 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 305 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 306 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 307 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 308 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 309 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 310 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 311 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 312 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 313 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 314 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 315 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 316 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 317 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 318 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 319 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 320 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 321 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 322 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 323 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 324 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 325 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 326 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 327 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 328 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 329 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 330 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 331 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 332 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 333 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 334 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 335 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 336 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 337 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 338 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 339 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 340 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 341 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 342 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 343 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 344 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 345 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 346 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 347 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 348 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 349 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 350 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 351 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 352 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 353 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 354 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 355 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 356 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 357 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 358 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 359 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 360 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 361 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 362 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 363 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 364 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 365 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 366 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 367 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 368 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 369 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 370 - DNA, 20 bp, synthetic construct
  misc_feature 1..20: note = Description of Artificial Sequence: Synthetic oligonucleotide
  source 1..20: mol_type = other DNA
ggccaaacctcggcttacct

SEQ ID NO: 371 - RNA, 20 nt, synthetic construct
  misc_feature 1..20: note = Description of Artificial Sequence: Synthetic oligonucleotide
  source 1..20: mol_type = other RNA
ggccaaacctcggcttacct

SEQ ID NO: 372 - DNA, 20 bp, synthetic construct
  misc_feature 1..20: note = Description of Artificial Sequence: Synthetic oligonucleotide
  source 1..20: mol_type = other DNA
ggccaaacctcggcttacct

SEQ ID NO: 373 - DNA, 20 bp, synthetic construct
  misc_feature 1..20: note = Description of Artificial Sequence: Synthetic oligonucleotide
  source 1..20: mol_type = other DNA
ggccaaacctcggcttacct

SEQ ID NO: 374 - DNA, 20 bp, synthetic construct
  misc_feature 1..20: note = Synthetic oligonucleotide
  modified_base 10: mod_base = OTHER; note = uracil
  source 1..20: mol_type = other DNA
ggccaaacctcggcttacct

SEQ ID NO: 375 - DNA, 20 bp, synthetic construct
  misc_feature 1..20: note = Synthetic oligonucleotide
  modified_base 20: mod_base = OTHER; note = uracil
  source 1..20: mol_type = other DNA
ggccaaacctcggcttacct

SEQ ID NO: 376 - DNA, 20 bp, synthetic construct
  misc_feature 1..20: note = Synthetic oligonucleotide
  modified_base 10: mod_base = OTHER; note = uracil
  modified_base 16: mod_base = OTHER; note = uracil
  modified_base 20: mod_base = OTHER; note = uracil
  source 1..20: mol_type = other DNA
ggccaaacctcggcttacct

SEQ ID NO: 377 - DNA, 20 bp, synthetic construct
  misc_feature 1..20: note = Synthetic oligonucleotide
  modified_base 15: mod_base = OTHER; note = uracil
  modified_base 20: mod_base = OTHER; note = uracil
  source 1..20: mol_type = other DNA
ggccaaacctcggcttacct

SEQ ID NO: 378 - DNA, 20 bp, synthetic construct
  misc_feature 1..20: note = Synthetic oligonucleotide
  modified_base 16: mod_base = OTHER; note = uracil
  modified_base 20: mod_base = OTHER; note = uracil
  source 1..20: mol_type = other DNA
ggccaaacctcggcttacct

SEQ ID NO: 379 - RNA, 20 nt, synthetic construct
  misc_feature 1..20: note = Description of Artificial Sequence: Synthetic oligonucleotide
  source 1..20: mol_type = other RNA
ggccaaacctcggcttacct

SEQ ID NO: 380 - DNA, 20 bp, synthetic construct
  misc_feature 1..20: note = Synthetic oligonucleotide
  modified_base 15: mod_base = OTHER; note = uracil
  modified_base 20: mod_base = OTHER; note = uracil
  source 1..20: mol_type = other DNA
ggccaaacctcggcttacct

SEQ ID NO: 381 - DNA, 20 bp, synthetic construct
  misc_feature 1..20: note = Synthetic oligonucleotide
  modified_base 16: mod_base = OTHER; note = uracil
  modified_base 20: mod_base = OTHER; note = uracil
  source 1..20: mol_type = other DNA
ggccaaacctcggcttacct

SEQ ID NO: 382 - DNA, 20 bp, synthetic construct
  misc_feature 1..20: note = Synthetic oligonucleotide
  modified_base 10: mod_base = OTHER; note = uracil
  modified_base 20: mod_base = OTHER; note = uracil
  source 1..20: mol_type = other DNA
ggccaaacctcggcttacct

SEQ ID NO: 383 - DNA, 20 bp, synthetic construct
  misc_feature 1..20: note = Synthetic oligonucleotide
  modified_base 10: mod_base = OTHER; note = uracil
  modified_base 15: mod_base = OTHER; note = uracil
  modified_base 20: mod_base = OTHER; note = uracil
  source 1..20: mol_type = other DNA
ggccaaacctcggcttacct

SEQ ID NO: 384 - DNA, 20 bp, synthetic construct
  misc_feature 1..20: note = Synthetic oligonucleotide
  modified_base 10: mod_base = OTHER; note = uracil
  source 1..20: mol_type = other DNA
ggccaaacctcggcttacct

SEQ ID NO: 385 - DNA, 20 bp, synthetic construct
  misc_feature 1..20: note = Synthetic oligonucleotide
  modified_base 20: mod_base = OTHER; note = uracil
  source 1..20: mol_type = other DNA
ggccaaacctcggcttacct

SEQ ID NO: 386 - DNA, 20 bp, synthetic construct
  misc_feature 1..20: note = Synthetic oligonucleotide
  modified_base 10: mod_base = OTHER; note = uracil
  modified_base 16: mod_base = OTHER; note = uracil
  modified_base 20: mod_base = OTHER; note = uracil
  source 1..20: mol_type = other DNA
ggccaaacctcggcttacct

SEQ ID NO: 387 - DNA, 20 bp, synthetic construct
  misc_feature 1..20: note = Synthetic oligonucleotide
  modified_base 15: mod_base = OTHER; note = uracil
  modified_base 20: mod_base = OTHER; note = uracil
  source 1..20: mol_type = other DNA
ggccaaacctcggcttacct

SEQ ID NO: 388 - DNA, 20 bp, synthetic construct
  misc_feature 1..20: note = Synthetic oligonucleotide
  modified_base 16: mod_base = OTHER; note = uracil
  modified_base 20: mod_base = OTHER; note = uracil
  source 1..20: mol_type = other DNA
ggccaaacctcggcttacct

SEQ ID NO: 389 - RNA, 20 nt, synthetic construct
  misc_feature 1..20: note = Description of Artificial Sequence: Synthetic oligonucleotide
  source 1..20: mol_type = other RNA
ggccaaacctcggcttacct

SEQ ID NO: 390 - DNA, 20 bp, synthetic construct
  misc_feature 1..20: note = Synthetic oligonucleotide
  modified_base 15: mod_base = OTHER; note = uracil
  modified_base 20: mod_base = OTHER; note = uracil
  source 1..20: mol_type = other DNA
ggccaaacctcggcttacct

SEQ ID NO: 391 - DNA, 20 bp, synthetic construct
  misc_feature 1..20: note = Synthetic oligonucleotide
  modified_base 16: mod_base = OTHER; note = uracil
  modified_base 20: mod_base = OTHER; note = uracil
  source 1..20: mol_type = other DNA
ggccaaacctcggcttacct

SEQ ID NO: 392 - DNA, 20 bp, synthetic construct
  misc_feature 1..20: note = Synthetic oligonucleotide
  modified_base 10: mod_base = OTHER; note = uracil
  modified_base 20: mod_base = OTHER; note = uracil
  source 1..20: mol_type = other DNA
ggccaaacctcggcttacct

SEQ ID NO: 393 - DNA, 20 bp, synthetic construct
  misc_feature 1..20: note = Synthetic oligonucleotide
  modified_base 10: mod_base = OTHER; note = uracil
  modified_base 15: mod_base = OTHER; note = uracil
  modified_base 20: mod_base = OTHER; note = uracil
  source 1..20: mol_type = other DNA
ggccaaacctcggcttacct

SEQ ID NO: 394 - RNA, 20 nt, synthetic construct
  misc_feature 1..20: note = Description of Artificial Sequence: Synthetic oligonucleotide
  source 1..20: mol_type = other RNA
ggccaaacctcggcttacct

SEQ ID NO: 395 - RNA, 20 nt, synthetic construct
  misc_feature 1..20: note = Description of Artificial Sequence: Synthetic oligonucleotide
  source 1..20: mol_type = other RNA
ggccaaacctcggcttacct

SEQ ID NO: 396 - RNA, 20 nt, synthetic construct
  misc_feature 1..20: note = Description of Artificial Sequence: Synthetic oligonucleotide
  source 1..20: mol_type = other RNA
ggccaaacctcggcttacct

SEQ ID NO: 397 - RNA, 20 nt, synthetic construct
  misc_feature 1..20: note = Description of Artificial Sequence: Synthetic oligonucleotide
  source 1..20: mol_type = other RNA
ggccaaacctcggcttacct

SEQ ID NO: 398 - RNA, 20 nt, synthetic construct
  misc_feature 1..20: note = Description of Artificial Sequence: Synthetic oligonucleotide
  source 1..20: mol_type = other RNA
ggccaaacctcggcttacct

SEQ ID NO: 399 - RNA, 20 nt, synthetic construct
  misc_feature 1..20: note = Description of Artificial Sequence: Synthetic oligonucleotide
  source 1..20: mol_type = other RNA
ggccaaacctcggcttacct

SEQ ID NO: 400 - RNA, 20 nt, synthetic construct
  misc_feature 1..20: note = Description of Artificial Sequence: Synthetic oligonucleotide
  source 1..20: mol_type = other RNA
ggccaaacctcggcttacct

SEQ ID NO: 401 - RNA, 20 nt, synthetic construct
  misc_feature 1..20: note = Description of Artificial Sequence: Synthetic oligonucleotide
  source 1..20: mol_type = other RNA
ggccaaacctcggcttacct

SEQ ID NO: 402 - RNA, 20 nt, synthetic construct
  misc_feature 1..20: note = Description of Artificial Sequence: Synthetic oligonucleotide
  source 1..20: mol_type = other RNA
ggccaaacctcggcttacct

SEQ ID NO: 403 - RNA, 20 nt, synthetic construct
  misc_feature 1..20: note = Description of Artificial Sequence: Synthetic oligonucleotide
  source 1..20: mol_type = other RNA
ggccaaacctcggcttacct

SEQ ID NO: 404 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 405 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 406 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 407 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 408 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 409 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 410 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 411 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 412 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 413 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 414 - RNA, 20 nt, synthetic construct
  misc_feature 1..20: note = Description of Artificial Sequence: Synthetic oligonucleotide
  source 1..20: mol_type = other RNA
ggccaaacctcggcttacct

SEQ ID NO: 415 - RNA, 20 nt, synthetic construct
  misc_feature 1..20: note = Description of Artificial Sequence: Synthetic oligonucleotide
  source 1..20: mol_type = other RNA
ggccaaacctcggcttacct

SEQ ID NO: 416 - RNA, 20 nt, synthetic construct
  misc_feature 1..20: note = Description of Artificial Sequence: Synthetic oligonucleotide
  source 1..20: mol_type = other RNA
ggccaaacctcggcttacct

SEQ ID NO: 417 - RNA, 20 nt, synthetic construct
  misc_feature 1..20: note = Description of Artificial Sequence: Synthetic oligonucleotide
  source 1..20: mol_type = other RNA
ggccaaacctcggcttacct

SEQ ID NO: 418 - RNA, 20 nt, synthetic construct
  misc_feature 1..20: note = Description of Artificial Sequence: Synthetic oligonucleotide
  source 1..20: mol_type = other RNA
ggccaaacctcggcttacct

SEQ ID NO: 419 - RNA, 20 nt, synthetic construct
  misc_feature 1..20: note = Description of Artificial Sequence: Synthetic oligonucleotide
  source 1..20: mol_type = other RNA
ggccaaacctcggcttacct

SEQ ID NO: 420 - RNA, 20 nt, synthetic construct
  misc_feature 1..20: note = Description of Artificial Sequence: Synthetic oligonucleotide
  source 1..20: mol_type = other RNA
ggccaaacctcggcttacct

SEQ ID NO: 421 - RNA, 20 nt, synthetic construct
  misc_feature 1..20: note = Description of Artificial Sequence: Synthetic oligonucleotide
  source 1..20: mol_type = other RNA
ggccaaacctcggcttacct

SEQ ID NO: 422 - RNA, 20 nt, synthetic construct
  misc_feature 1..20: note = Description of Artificial Sequence: Synthetic oligonucleotide
  source 1..20: mol_type = other RNA
agaaatgccatcttccttga

SEQ ID NO: 423 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 424 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 425 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 426 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 427 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 428 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 429 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 430 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 431 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 432 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 433 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 434 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 435 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 436 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 437 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 438 - RNA, 30 nt, synthetic construct; identical to SEQ ID NO: 75
  misc_feature 1..30: note = Description of Artificial Sequence: Synthetic oligonucleotide
  source 1..30: mol_type = other RNA

SEQ ID NO: 439 - RNA, 25 nt, synthetic construct
  misc_feature 1..25: note = Description of Artificial Sequence: Synthetic oligonucleotide
  source 1..25: mol_type = other RNA
accagagtaacagtctgagtaggag

SEQ ID NO: 440 - RNA, 25 nt, synthetic construct
  misc_feature 1..25: note = Description of Artificial Sequence: Synthetic oligonucleotide
  source 1..25: mol_type = other RNA
caccagagtaacagtctgagtagga

SEQ ID NO: 441 - RNA, 25 nt, synthetic construct
  misc_feature 1..25: note = Description of Artificial Sequence: Synthetic oligonucleotide
  source 1..25: mol_type = other RNA
tcaccagagtaacagtctgagtagg

SEQ ID NO: 442 - RNA, 25 nt, synthetic construct
  misc_feature 1..25: note = Description of Artificial Sequence: Synthetic oligonucleotide
  source 1..25: mol_type = other RNA
gtcaccagagtaacagtctgagtag

SEQ ID NO: 443 - RNA, 25 nt, synthetic construct
  misc_feature 1..25: note = Description of Artificial Sequence: Synthetic oligonucleotide
  source 1..25: mol_type = other RNA
gttgtgtcaccagagtaacagtctg

SEQ ID NO: 444 - RNA, 25 nt, synthetic construct
  misc_feature 1..25: note = Description of Artificial Sequence: Synthetic oligonucleotide
  source 1..25: mol_type = other RNA
ggttgtgtcaccagagtaacagtct

SEQ ID NO: 445 - RNA, 25 nt, synthetic construct
  misc_feature 1..25: note = Description of Artificial Sequence: Synthetic oligonucleotide
  source 1..25: mol_type = other RNA
aggttgtgtcaccagagtaacagtc

SEQ ID NO: 446 - RNA, 25 nt, synthetic construct
  misc_feature 1..25: note = Description of Artificial Sequence: Synthetic oligonucleotide
  source 1..25: mol_type = other RNA
caggttgtgtcaccagagtaacagt

SEQ ID NO: 447 - RNA, 25 nt, synthetic construct
  misc_feature 1..25: note = Description of Artificial Sequence: Synthetic oligonucleotide
  source 1..25: mol_type = other RNA
acaggttgtgtcaccagagtaacag

SEQ ID NO: 448 - RNA, 25 nt, synthetic construct
  misc_feature 1..25: note = Description of Artificial Sequence: Synthetic oligonucleotide
  source 1..25: mol_type = other RNA
ccacaggttgtgtcaccagagtaac

SEQ ID NO: 449 - RNA, 25 nt, synthetic construct
  misc_feature 1..25: note = Description of Artificial Sequence: Synthetic oligonucleotide
  source 1..25: mol_type = other RNA
accacaggttgtgtcaccagagtaa

SEQ ID NO: 450 - RNA, 25 nt, synthetic construct
  misc_feature 1..25: note = Description of Artificial Sequence: Synthetic oligonucleotide
  source 1..25: mol_type = other RNA
aaccacaggttgtgtcaccagagta

SEQ ID NO: 451 - RNA, 25 nt, synthetic construct
  misc_feature 1..25: note = Description of Artificial Sequence: Synthetic oligonucleotide
  source 1..25: mol_type = other RNA
taaccacaggttgtgtcaccagagt

SEQ ID NO: 452 - RNA, 25 nt, synthetic construct
  misc_feature 1..25: note = Description of Artificial Sequence: Synthetic oligonucleotide
  source 1..25: mol_type = other RNA
gtaaccacaggttgtgtcaccagag

SEQ ID NO: 453 - RNA, 25 nt, synthetic construct
  misc_feature 1..25: note = Description of Artificial Sequence: Synthetic oligonucleotide
  source 1..25: mol_type = other RNA
agtaaccacaggttgtgtcaccaga

SEQ ID NO: 454 - RNA, 25 nt, synthetic construct
  misc_feature 1..25: note = Description of Artificial Sequence: Synthetic oligonucleotide
  source 1..25: mol_type = other RNA
tagtaaccacaggttgtgtcaccag

SEQ ID NO: 455 - RNA, 25 nt, synthetic construct
  misc_feature 1..25: note = Description of Artificial Sequence: Synthetic oligonucleotide
  source 1..25: mol_type = other RNA
ttagtaaccacaggttgtgtcacca

SEQ ID NO: 456 - RNA, 25 nt, synthetic construct
  misc_feature 1..25: note = Description of Artificial Sequence: Synthetic oligonucleotide
  source 1..25: mol_type = other RNA
cttagtaaccacaggttgtgtcacc

SEQ ID NO: 457 - RNA, 25 nt, synthetic construct
  misc_feature 1..25: note = Description of Artificial Sequence: Synthetic oligonucleotide
  source 1..25: mol_type = other RNA
ccttagtaaccacaggttgtgtcac

SEQ ID NO: 458 - RNA, 25 nt, synthetic construct
  misc_feature 1..25: note = Description of Artificial Sequence: Synthetic oligonucleotide
  source 1..25: mol_type = other RNA
tccttagtaaccacaggttgtgtca

SEQ ID NO: 459 - RNA, 25 nt, synthetic construct
  misc_feature 1..25: note = Description of Artificial Sequence: Synthetic oligonucleotide
  source 1..25: mol_type = other RNA
gtttccttagtaaccacaggttgtg

SEQ ID NO: 460 - RNA, 25 nt, synthetic construct
  misc_feature 1..25: note = Description of Artificial Sequence: Synthetic oligonucleotide
  source 1..25: mol_type = other RNA
agtttccttagtaaccacaggttgt

SEQ ID NO: 461 - RNA, 25 nt, synthetic construct
  misc_feature 1..25: note = Description of Artificial Sequence: Synthetic oligonucleotide
  source 1..25: mol_type = other RNA
cagtttccttagtaaccacaggttg

SEQ ID NO: 462 - RNA, 25 nt, synthetic construct
  misc_feature 1..25: note = Description of Artificial Sequence: Synthetic oligonucleotide
  source 1..25: mol_type = other RNA
gcagtttccttagtaaccacaggtt

SEQ ID NO: 463 - RNA, 25 nt, synthetic construct
  misc_feature 1..25: note = Description of Artificial Sequence: Synthetic oligonucleotide
  source 1..25: mol_type = other RNA
ggcagtttccttagtaaccacaggt

SEQ ID NO: 464 - RNA, 25 nt, synthetic construct
  misc_feature 1..25: note = Description of Artificial Sequence: Synthetic oligonucleotide
  source 1..25: mol_type = other RNA
tggcagtttccttagtaaccacagg

SEQ ID NO: 465 - RNA, 25 nt, synthetic construct
  misc_feature 1..25: note = Description of Artificial Sequence: Synthetic oligonucleotide
  source 1..25: mol_type = other RNA
atggcagtttccttagtaaccacag

SEQ ID NO: 466 - RNA, 25 nt, synthetic construct
  misc_feature 1..25: note = Description of Artificial Sequence: Synthetic oligonucleotide
  source 1..25: mol_type = other RNA
agatggcagtttccttagtaaccac

SEQ ID NO: 467 - RNA, 25 nt, synthetic construct
  misc_feature 1..25: note = Description of Artificial Sequence: Synthetic oligonucleotide
  source 1..25: mol_type = other RNA
gagatggcagtttccttagtaacca

SEQ ID NO: 468 - RNA, 25 nt, synthetic construct
  misc_feature 1..25: note = Description of Artificial Sequence: Synthetic oligonucleotide
  source 1..25: mol_type = other RNA
ggagatggcagtttccttagtaacc

SEQ ID NO: 469 - RNA, 25 nt, synthetic construct
  misc_feature 1..25: note = Description of Artificial Sequence: Synthetic oligonucleotide
  source 1..25: mol_type = other RNA
tggagatggcagtttccttagtaac

SEQ ID NO: 470 - RNA, 25 nt, synthetic construct
  misc_feature 1..25: note = Description of Artificial Sequence: Synthetic oligonucleotide
  source 1..25: mol_type = other RNA
ttggagatggcagtttccttagtaa

SEQ ID NO: 471 - RNA, 25 nt, synthetic construct
  misc_feature 1..25: note = Description of Artificial Sequence: Synthetic oligonucleotide
  source 1..25: mol_type = other RNA
tttggagatggcagtttccttagta

SEQ ID NO: 472 - RNA, 25 nt, synthetic construct
  misc_feature 1..25: note = Description of Artificial Sequence: Synthetic oligonucleotide
  source 1..25: mol_type = other RNA
agtttggagatggcagtttccttag

SEQ ID NO: 473 - RNA, 25 nt, synthetic construct
  misc_feature 1..25: note = Description of Artificial Sequence: Synthetic oligonucleotide
  source 1..25: mol_type = other RNA
tagtttggagatggcagtttcctta

SEQ ID NO: 474 - RNA, 25 nt, synthetic construct
  misc_feature 1..25: note = Description of Artificial Sequence: Synthetic oligonucleotide
  source 1..25: mol_type = other RNA
ctagtttggagatggcagtttcctt

SEQ ID NO: 475 - RNA, 25 nt, synthetic construct
  misc_feature 1..25: note = Description of Artificial Sequence: Synthetic oligonucleotide
  source 1..25: mol_type = other RNA
tctagtttggagatggcagtttcct

SEQ ID NO: 476 - RNA, 25 nt, synthetic construct
  misc_feature 1..25: note = Description of Artificial Sequence: Synthetic oligonucleotide
  source 1..25: mol_type = other RNA
ttctagtttggagatggcagtttcc

SEQ ID NO: 477 - RNA, 25 nt, synthetic construct
  misc_feature 1..25: note = Description of Artificial Sequence: Synthetic oligonucleotide
  source 1..25: mol_type = other RNA
catttctagtttggagatggcagtt

SEQ ID NO: 478 - RNA, 25 nt, synthetic construct
  misc_feature 1..25: note = Description of Artificial Sequence: Synthetic oligonucleotide
  source 1..25: mol_type = other RNA
gcatttctagtttggagatggcagt

SEQ ID NO: 479 - RNA, 25 nt, synthetic construct
  misc_feature 1..25: note = Description of Artificial Sequence: Synthetic oligonucleotide
  source 1..25: mol_type = other RNA
atggcatttctagtttggagatggc

SEQ ID NO: 480 - RNA, 25 nt, synthetic construct
  misc_feature 1..25: note = Description of Artificial Sequence: Synthetic oligonucleotide
  source 1..25: mol_type = other RNA
gaagatggcatttctagtttggaga

SEQ ID NO: 481 - RNA, 25 nt, synthetic construct
  misc_feature 1..25: note = Description of Artificial Sequence: Synthetic oligonucleotide
  source 1..25: mol_type = other RNA
aggaagatggcatttctagtttgga

SEQ ID NO: 482 - RNA, 25 nt, synthetic construct
  misc_feature 1..25: note = Description of Artificial Sequence: Synthetic oligonucleotide
  source 1..25: mol_type = other RNA
aaggaagatggcatttctagtttgg

SEQ ID NO: 483 - RNA, 25 nt, synthetic construct
  misc_feature 1..25: note = Description of Artificial Sequence: Synthetic oligonucleotide
  source 1..25: mol_type = other RNA
caaggaagatggcatttctagtttg

SEQ ID NO: 484 - RNA, 25 nt, synthetic construct
  misc_feature 1..25: note = Description of Artificial Sequence: Synthetic oligonucleotide
  source 1..25: mol_type = other RNA
catcaaggaagatggcatttctagt

SEQ ID NO: 485 - RNA, 25 nt, synthetic construct
  misc_feature 1..25: note = Description of Artificial Sequence: Synthetic oligonucleotide
  source 1..25: mol_type = other RNA
acatcaaggaagatggcatttctag

SEQ ID NO: 486 - RNA, 25 nt, synthetic construct
  misc_feature 1..25: note = Description of Artificial Sequence: Synthetic oligonucleotide
  source 1..25: mol_type = other RNA
aacatcaaggaagatggcatttcta

SEQ ID NO: 487 - RNA, 25 nt, synthetic construct
  misc_feature 1..25: note = Description of Artificial Sequence: Synthetic oligonucleotide
  source 1..25: mol_type = other RNA
caacatcaaggaagatggcatttct

SEQ ID NO: 488 - RNA, 25 nt, synthetic construct
  misc_feature 1..25: note = Description of Artificial Sequence: Synthetic oligonucleotide
  source 1..25: mol_type = other RNA
ctccaacatcaaggaagatggcatt

SEQ ID NO: 489 - RNA, 25 nt, synthetic construct
  misc_feature 1..25: note = Description of Artificial Sequence: Synthetic oligonucleotide
  source 1..25: mol_type = other RNA
acctccaacatcaaggaagatggca

SEQ ID NO: 490 - RNA, 25 nt, synthetic construct
  misc_feature 1..25: note = Description of Artificial Sequence: Synthetic oligonucleotide
  source 1..25: mol_type = other RNA
gtacctccaacatcaaggaagatgg

SEQ ID NO: 491 - RNA, 25 nt, synthetic construct
  misc_feature 1..25: note = Description of Artificial Sequence: Synthetic oligonucleotide
  source 1..25: mol_type = other RNA
aggtacctccaacatcaaggaagat

SEQ ID NO: 492 - RNA, 25 nt, synthetic construct
  misc_feature 1..25: note = Description of Artificial Sequence: Synthetic oligonucleotide
  source 1..25: mol_type = other RNA
agagcaggtacctccaacatcaagg

SEQ ID NO: 493 - RNA, 25 nt, synthetic construct
  misc_feature 1..25: note = Description of Artificial Sequence: Synthetic oligonucleotide
  source 1..25: mol_type = other RNA
cagagcaggtacctccaacatcaag

SEQ ID NO: 494 - RNA, 25 nt, synthetic construct
  misc_feature 1..25: note = Description of Artificial Sequence: Synthetic oligonucleotide
  source 1..25: mol_type = other RNA
ctgccagagcaggtacctccaacat

SEQ ID NO: 495 - RNA, 25 nt, synthetic construct
  misc_feature 1..25: note = Description of Artificial Sequence: Synthetic oligonucleotide
  source 1..25: mol_type = other RNA
tctgccagagcaggtacctccaaca

SEQ ID NO: 496 - RNA, 25 nt, synthetic construct
  misc_feature 1..25: note = Description of Artificial Sequence: Synthetic oligonucleotide
  source 1..25: mol_type = other RNA
atctgccagagcaggtacctccaac

SEQ ID NO: 497 - RNA, 25 nt, synthetic construct
  misc_feature 1..25: note = Description of Artificial Sequence: Synthetic oligonucleotide
  source 1..25: mol_type = other RNA
aatctgccagagcaggtacctccaa

SEQ ID NO: 498 - RNA, 25 nt, synthetic construct
  misc_feature 1..25: note = Description of Artificial Sequence: Synthetic oligonucleotide
  source 1..25: mol_type = other RNA
aaatctgccagagcaggtacctcca

SEQ ID NO: 499 - RNA, 25 nt, synthetic construct
  misc_feature 1..25: note = Description of Artificial Sequence: Synthetic oligonucleotide
  source 1..25: mol_type = other RNA
gaaatctgccagagcaggtacctcc

SEQ ID NO: 500 - RNA, 25 nt, synthetic construct
  misc_feature 1..25: note = Description of Artificial Sequence: Synthetic oligonucleotide
  source 1..25: mol_type = other RNA
tgaaatctgccagagcaggtacctc

SEQ ID NO: 501 - RNA, 25 nt, synthetic construct
  misc_feature 1..25: note = Description of Artificial Sequence: Synthetic oligonucleotide
  source 1..25: mol_type = other RNA
ttgaaatctgccagagcaggtacct

SEQ ID NO: 502 - RNA, 25 nt, synthetic construct
  misc_feature 1..25: note = Description of Artificial Sequence: Synthetic oligonucleotide
  source 1..25: mol_type = other RNA
cccggttgaaatctgccagagcagg

SEQ ID NO: 503 - RNA, 25 nt, synthetic construct
  misc_feature 1..25: note = Description of Artificial Sequence: Synthetic oligonucleotide
  source 1..25: mol_type = other RNA
ccaagcccggttgaaatctgccaga

SEQ ID NO: 504 - RNA, 25 nt, synthetic construct
  misc_feature 1..25: note = Description of Artificial Sequence: Synthetic oligonucleotide
  source 1..25: mol_type = other RNA
tccaagcccggttgaaatctgccag

SEQ ID NO: 505 - RNA, 25 nt, synthetic construct
  misc_feature 1..25: note = Description of Artificial Sequence: Synthetic oligonucleotide
  source 1..25: mol_type = other RNA
gtccaagcccggttgaaatctgcca

SEQ ID NO: 506 - RNA, 25 nt, synthetic construct
  misc_feature 1..25: note = Description of Artificial Sequence: Synthetic oligonucleotide
  source 1..25: mol_type = other RNA
tctgtccaagcccggttgaaatctg

SEQ ID NO: 507 - RNA, 25 nt, synthetic construct
  misc_feature 1..25: note = Description of Artificial Sequence: Synthetic oligonucleotide
  source 1..25: mol_type = other RNA
ttctgtccaagcccggttgaaatct

SEQ ID NO: 508 - RNA, 25 nt, synthetic construct
  misc_feature 1..25: note = Description of Artificial Sequence: Synthetic oligonucleotide
  source 1..25: mol_type = other RNA
gttctgtccaagcccggttgaaatc

SEQ ID NO: 509 - RNA, 25 nt, synthetic construct
  misc_feature 1..25: note = Description of Artificial Sequence: Synthetic oligonucleotide
  source 1..25: mol_type = other RNA
agttctgtccaagcccggttgaaat

SEQ ID NO: 510 - RNA, 25 nt, synthetic construct
  misc_feature 1..25: note = Description of Artificial Sequence: Synthetic oligonucleotide
  source 1..25: mol_type = other RNA
aagttctgtccaagcccggttgaaa

SEQ ID NO: 511 - RNA, 25 nt, synthetic construct
  misc_feature 1..25: note = Description of Artificial Sequence: Synthetic oligonucleotide
  source 1..25: mol_type = other RNA
taagttctgtccaagcccggttgaa

SEQ ID NO: 512 - RNA, 25 nt, synthetic construct
  misc_feature 1..25: note = Description of Artificial Sequence: Synthetic oligonucleotide
  source 1..25: mol_type = other RNA
gtaagttctgtccaagcccggttga

SEQ ID NO: 513 - RNA, 25 nt, synthetic construct
  misc_feature 1..25: note = Description of Artificial Sequence: Synthetic oligonucleotide
  source 1..25: mol_type = other RNA
ggtaagttctgtccaagcccggttg

SEQ ID NO: 514 - RNA, 25 nt, synthetic construct
  misc_feature 1..25: note = Description of Artificial Sequence: Synthetic oligonucleotide
  source 1..25: mol_type = other RNA
cggtaagttctgtccaagcccggtt

SEQ ID NO: 515 - RNA, 25 nt, synthetic construct
  misc_feature 1..25: note = Description of Artificial Sequence: Synthetic oligonucleotide
  source 1..25: mol_type = other RNA
tcggtaagttctgtccaagcccggt

SEQ ID NO: 516 - RNA, 25 nt, synthetic construct
  misc_feature 1..25: note = Description of Artificial Sequence: Synthetic oligonucleotide
  source 1..25: mol_type = other RNA
gtcggtaagttctgtccaagcccgg

SEQ ID NO: 517 - RNA, 25 nt, synthetic construct
  misc_feature 1..25: note = Description of Artificial Sequence: Synthetic oligonucleotide
  source 1..25: mol_type = other RNA
agtcggtaagttctgtccaagcccg

SEQ ID NO: 518 - RNA, 25 nt, synthetic construct
  misc_feature 1..25: note = Description of Artificial Sequence: Synthetic oligonucleotide
  source 1..25: mol_type = other RNA
cagtcggtaagttctgtccaagccc

SEQ ID NO: 519 - RNA, 25 nt, synthetic construct
  misc_feature 1..25: note = Description of Artificial Sequence: Synthetic oligonucleotide
  source 1..25: mol_type = other RNA
aaagccagtcggtaagttctgtcca

SEQ ID NO: 520 - RNA, 25 nt, synthetic construct
  misc_feature 1..25: note = Description of Artificial Sequence: Synthetic oligonucleotide
  source 1..25: mol_type = other RNA
gaaagccagtcggtaagttctgtcc

SEQ ID NO: 521 - RNA, 25 nt, synthetic construct
  misc_feature 1..25: note = Description of Artificial Sequence: Synthetic oligonucleotide
  source 1..25: mol_type = other RNA
gtcacccaccatcaccctctgtgat

SEQ ID NO: 522 - RNA, 25 nt, synthetic construct
  misc_feature 1..25: note = Description of Artificial Sequence: Synthetic oligonucleotide
  source 1..25: mol_type = other RNA
ggtcacccaccatcaccctctgtga

SEQ ID NO: 523 - RNA, 25 nt, synthetic construct
  misc_feature 1..25: note = Description of Artificial Sequence: Synthetic oligonucleotide
  source 1..25: mol_type = other RNA
aaggtcacccaccatcaccctctgt

SEQ ID NO: 524 - RNA, 25 nt, synthetic construct
  misc_feature 1..25: note = Description of Artificial Sequence: Synthetic oligonucleotide
  source 1..25: mol_type = other RNA
caaggtcacccaccatcaccctctg

SEQ ID NO: 525 - RNA, 25 nt, synthetic construct
  misc_feature 1..25: note = Description of Artificial Sequence: Synthetic oligonucleotide
  source 1..25: mol_type = other RNA
tcaaggtcacccaccatcaccctct

SEQ ID NO: 526 - RNA, 25 nt, synthetic construct
  misc_feature 1..25: note = Description of Artificial Sequence: Synthetic oligonucleotide
  source 1..25: mol_type = other RNA
ctcaaggtcacccaccatcaccctc

SEQ ID NO: 527 - RNA, 25 nt, synthetic construct
  misc_feature 1..25: note = Description of Artificial Sequence: Synthetic oligonucleotide
  source 1..25: mol_type = other RNA
cttgatcaagcagagaaagccagtc

SEQ ID NO: 528 - RNA, 25 nt, synthetic construct
  misc_feature 1..25: note = Description of Artificial Sequence: Synthetic oligonucleotide
  source 1..25: mol_type = other RNA
ataacttgatcaagcagagaaagcc

SEQ ID NO: 529 - RNA, 20 nt, synthetic construct
  misc_feature 1..20: note = Description of Artificial Sequence: Synthetic oligonucleotide
  source 1..20: mol_type = other RNA
agtaacagtctgagtaggag

SEQ ID NO: 530 - RNA, 20 nt, synthetic construct
  misc_feature 1..20: note = Description of Artificial Sequence: Synthetic oligonucleotide
  source 1..20: mol_type = other RNA
gagtaacagtctgagtagga

SEQ ID NO: 531 - RNA, 20 nt, synthetic construct
  misc_feature 1..20: note = Description of Artificial Sequence: Synthetic oligonucleotide
  source 1..20: mol_type = other RNA
agagtaacagtctgagtagg

SEQ ID NO: 532 - RNA, 20 nt, synthetic construct
  misc_feature 1..20: note = Description of Artificial Sequence: Synthetic oligonucleotide
  source 1..20: mol_type = other RNA
cagagtaacagtctgagtag

SEQ ID NO: 533 - RNA, 20 nt, synthetic construct
  misc_feature 1..20: note = Description of Artificial Sequence: Synthetic oligonucleotide
  source 1..20: mol_type = other RNA
gtcaccagagtaacagtctg

SEQ ID NO: 534 - RNA, 20 nt, synthetic construct
  misc_feature 1..20: note = Description of Artificial Sequence: Synthetic oligonucleotide
  source 1..20: mol_type = other RNA
tgtcaccagagtaacagtct

SEQ ID NO: 535 - RNA, 20 nt, synthetic construct
  misc_feature 1..20: note = Description of Artificial Sequence: Synthetic oligonucleotide
  source 1..20: mol_type = other RNA
gtgtcaccagagtaacagtc

SEQ ID NO: 536 - RNA, 20 nt, synthetic construct
  misc_feature 1..20: note = Description of Artificial Sequence: Synthetic oligonucleotide
  source 1..20: mol_type = other RNA
tgtgtcaccagagtaacagt

SEQ ID NO: 537 - RNA, 20 nt, synthetic construct
  misc_feature 1..20: note = Description of Artificial Sequence: Synthetic oligonucleotide
  source 1..20: mol_type = other RNA
ttgtgtcaccagagtaacag

SEQ ID NO: 538 - RNA, 20 nt, synthetic construct
  misc_feature 1..20: note = Description of Artificial Sequence: Synthetic oligonucleotide
  source 1..20: mol_type = other RNA
ggttgtgtcaccagagtaac

SEQ ID NO: 539 - RNA, 20 nt, synthetic construct
  misc_feature 1..20: note = Description of Artificial Sequence: Synthetic oligonucleotide
  source 1..20: mol_type = other RNA
aggttgtgtcaccagagtaa

SEQ ID NO: 540 - RNA, 20 nt, synthetic construct
  misc_feature 1..20: note = Description of Artificial Sequence: Synthetic oligonucleotide
  source 1..20: mol_type = other RNA
caggttgtgtcaccagagta

SEQ ID NO: 541 - RNA, 20 nt, synthetic construct
  misc_feature 1..20: note = Description of Artificial Sequence: Synthetic oligonucleotide
  source 1..20: mol_type = other RNA
acaggttgtgtcaccagagt

SEQ ID NO: 542 - RNA, 20 nt, synthetic construct
  misc_feature 1..20: note = Description of Artificial Sequence: Synthetic oligonucleotide
  source 1..20: mol_type = other RNA
cacaggttgtgtcaccagag

SEQ ID NO: 543 - RNA, 20 nt, synthetic construct
  misc_feature 1..20: note = Description of Artificial Sequence: Synthetic oligonucleotide
  source 1..20: mol_type = other RNA
ccacaggttgtgtcaccaga

SEQ ID NO: 544 - RNA, 20 nt, synthetic construct
  misc_feature 1..20: note = Description of Artificial Sequence: Synthetic oligonucleotide
  source 1..20: mol_type = other RNA
accacaggttgtgtcaccag

SEQ ID NO: 545 - RNA, 20 nt, synthetic construct
  misc_feature 1..20: note = Description of Artificial Sequence: Synthetic oligonucleotide
  source 1..20: mol_type = other RNA
aaccacaggttgtgtcacca

SEQ ID NO: 546 - RNA, 20 nt, synthetic construct
  misc_feature 1..20: note = Description of Artificial Sequence: Synthetic oligonucleotide
  source 1..20: mol_type = other RNA
taaccacaggttgtgtcacc

SEQ ID NO: 547 - RNA, 20 nt, synthetic construct
  misc_feature 1..20: note = Description of Artificial Sequence: Synthetic oligonucleotide
  source 1..20: mol_type = other RNA
gtaaccacaggttgtgtcac

SEQ ID NO: 548 - RNA, 20 nt, synthetic construct
  misc_feature 1..20: note = Description of Artificial Sequence: Synthetic oligonucleotide
  source 1..20: mol_type = other RNA
agtaaccacaggttgtgtca

SEQ ID NO: 549 - RNA, 20 nt, synthetic construct
  misc_feature 1..20: note = Description of Artificial Sequence: Synthetic oligonucleotide
  source 1..20: mol_type = other RNA
cttagtaaccacaggttgtg

SEQ ID NO: 550 - RNA, 20 nt, synthetic construct
  misc_feature 1..20: note = Description of Artificial Sequence: Synthetic oligonucleotide
  source 1..20: mol_type = other RNA
ccttagtaaccacaggttgt

SEQ ID NO: 551 - RNA, 20 nt, synthetic construct
  misc_feature 1..20: note = Description of Artificial Sequence: Synthetic oligonucleotide
  source 1..20: mol_type = other RNA
tccttagtaaccacaggttg

SEQ ID NO: 552 - RNA, 20 nt, synthetic construct
  misc_feature 1..20: note = Description of Artificial Sequence: Synthetic oligonucleotide
  source 1..20: mol_type = other RNA
ttccttagtaaccacaggtt

SEQ ID NO: 553 - RNA, 20 nt, synthetic construct
  misc_feature 1..20: note = Description of Artificial Sequence: Synthetic oligonucleotide
  source 1..20: mol_type = other RNA
tttccttagtaaccacaggt

SEQ ID NO: 554 - RNA, 20 nt, synthetic construct
  misc_feature 1..20: note = Description of Artificial Sequence: Synthetic oligonucleotide
  source 1..20: mol_type = other RNA
gtttccttagtaaccacagg

SEQ ID NO: 555 - RNA, 20 nt, synthetic construct
  misc_feature 1..20: note = Description of Artificial Sequence: Synthetic oligonucleotide
  source 1..20: mol_type = other RNA
agtttccttagtaaccacag

SEQ ID NO: 556 - RNA, 20 nt, synthetic construct
  misc_feature 1..20: note = Description of Artificial Sequence: Synthetic oligonucleotide
  source 1..20: mol_type = other RNA
gcagtttccttagtaaccac

SEQ ID NO: 557 - RNA, 20 nt, synthetic construct
  misc_feature 1..20: note = Description of Artificial Sequence: Synthetic oligonucleotide
  source 1..20: mol_type = other RNA
ggcagtttccttagtaacca

SEQ ID NO: 558 - RNA, 20 nt, synthetic construct
  misc_feature 1..20: note = Description of Artificial Sequence: Synthetic oligonucleotide
  source 1..20: mol_type = other RNA
tggcagtttccttagtaacc

SEQ ID NO: 559 - RNA, 20 nt, synthetic construct
  misc_feature 1..20: note = Description of Artificial Sequence: Synthetic oligonucleotide
  source 1..20: mol_type = other RNA
atggcagtttccttagtaac

SEQ ID NO: 560 - RNA, 20 nt, synthetic construct
  misc_feature 1..20: note = Description of Artificial Sequence: Synthetic oligonucleotide
  source 1..20: mol_type = other RNA
gatggcagtttccttagtaa

SEQ ID NO: 561 - RNA, 20 nt, synthetic construct
  misc_feature 1..20: note = Description of Artificial Sequence: Synthetic oligonucleotide
  source 1..20: mol_type = other RNA
agatggcagtttccttagta

SEQ ID NO: 562 - RNA, 20 nt, synthetic construct
  misc_feature 1..20: note = Description of Artificial Sequence: Synthetic oligonucleotide
  source 1..20: mol_type = other RNA
ggagatggcagtttccttag

SEQ ID NO: 563 - RNA, 20 nt, synthetic construct
  misc_feature 1..20: note = Description of Artificial Sequence: Synthetic oligonucleotide
  source 1..20: mol_type = other RNA
tggagatggcagtttcctta

SEQ ID NO: 564 - RNA, 20 nt, synthetic construct
  misc_feature 1..20: note = Description of Artificial Sequence: Synthetic oligonucleotide
  source 1..20: mol_type = other RNA
ttggagatggcagtttcctt

SEQ ID NO: 565 - RNA, 20 nt, synthetic construct
  misc_feature 1..20: note = Description of Artificial Sequence: Synthetic oligonucleotide
  source 1..20: mol_type = other RNA
tttggagatggcagtttcct

SEQ ID NO: 566 - RNA, 20 nt, synthetic construct
  misc_feature 1..20: note = Description of Artificial Sequence: Synthetic oligonucleotide
  source 1..20: mol_type = other RNA
gtttggagatggcagtttcc

SEQ ID NO: 567 - RNA, 20 nt, synthetic construct
  misc_feature 1..20: note = Description of Artificial Sequence: Synthetic oligonucleotide
  source 1..20: mol_type = other RNA
ctagtttggagatggcagtt

SEQ ID NO: 568 - RNA, 20 nt, synthetic construct
  misc_feature 1..20: note = Description of Artificial Sequence: Synthetic oligonucleotide
  source 1..20: mol_type = other RNA
tctagtttggagatggcagt

SEQ ID NO: 569 - RNA, 20 nt, synthetic construct
  misc_feature 1..20: note = Description of Artificial Sequence: Synthetic oligonucleotide
  source 1..20: mol_type = other RNA
atttctagtttggagatggc

SEQ ID NO: 570 - RNA, 20 nt, synthetic construct
  misc_feature 1..20: note = Description of Artificial Sequence: Synthetic oligonucleotide
  source 1..20: mol_type = other RNA
tggcatttctagtttggaga

SEQ ID NO: 571 - RNA, 20 nt, synthetic construct
  misc_feature 1..20: note = Description of Artificial Sequence: Synthetic oligonucleotide
  source 1..20: mol_type = other RNA
gatggcatttctagtttgga

SEQ ID NO: 572 - RNA, 20 nt, synthetic construct
  misc_feature 1..20: note = Description of Artificial Sequence: Synthetic oligonucleotide
  source 1..20: mol_type = other RNA
agatggcatttctagtttgg

SEQ ID NO: 573 - RNA, 20 nt, synthetic construct
  misc_feature 1..20: note = Description of Artificial Sequence: Synthetic oligonucleotide
  source 1..20: mol_type = other RNA
aagatggcatttctagtttg

SEQ ID NO: 574 - RNA, 20 nt, synthetic construct
  misc_feature 1..20: note = Description of Artificial Sequence: Synthetic oligonucleotide
  source 1..20: mol_type = other RNA
aggaagatggcatttctagt

SEQ ID NO: 575 - RNA, 20 nt, synthetic construct
  misc_feature 1..20: note = Description of Artificial Sequence: Synthetic oligonucleotide
  source 1..20: mol_type = other RNA
aaggaagatggcatttctag

SEQ ID NO: 576 - RNA, 20 nt, synthetic construct
  misc_feature 1..20: note = Description of Artificial Sequence: Synthetic oligonucleotide
  source 1..20: mol_type = other RNA
caaggaagatggcatttcta

SEQ ID NO: 577 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 578 - RNA, 20 nt, synthetic construct
  misc_feature 1..20: note = Description of Artificial Sequence: Synthetic oligonucleotide
  source 1..20: mol_type = other RNA
acatcaaggaagatggcatt

SEQ ID NO: 579 - RNA, 20 nt, synthetic construct
  misc_feature 1..20: note = Description of Artificial Sequence: Synthetic oligonucleotide
  source 1..20: mol_type = other RNA
caacatcaaggaagatggca

SEQ ID NO: 580 - RNA, 20 nt, synthetic construct
  misc_feature 1..20: note = Description of Artificial Sequence: Synthetic oligonucleotide
  source 1..20: mol_type = other RNA
tccaacatcaaggaagatgg

SEQ ID NO: 581 - RNA, 20 nt, synthetic construct
  misc_feature 1..20: note = Description of Artificial Sequence: Synthetic oligonucleotide
  source 1..20: mol_type = other RNA
cctccaacatcaaggaagat

SEQ ID NO: 582 - RNA, 20 nt, synthetic construct
  misc_feature 1..20: note = Description of Artificial Sequence: Synthetic oligonucleotide
  source 1..20: mol_type = other RNA
aggtacctccaacatcaagg

SEQ ID NO: 583 - RNA, 20 nt, synthetic construct
  misc_feature 1..20: note = Description of Artificial Sequence: Synthetic oligonucleotide
  source 1..20: mol_type = other RNA
caggtacctccaacatcaag

SEQ ID NO: 584 - RNA, 20 nt, synthetic construct
  misc_feature 1..20: note = Description of Artificial Sequence: Synthetic oligonucleotide
  source 1..20: mol_type = other RNA
agagcaggtacctccaacat

SEQ ID NO: 585 - RNA, 20 nt, synthetic construct
  misc_feature 1..20: note = Description of Artificial Sequence: Synthetic oligonucleotide
  source 1..20: mol_type = other RNA
cagagcaggtacctccaaca

SEQ ID NO: 586 - RNA, 20 nt, synthetic construct
  misc_feature 1..20: note = Description of Artificial Sequence: Synthetic oligonucleotide
  source 1..20: mol_type = other RNA
ccagagcaggtacctccaac

SEQ ID NO: 587 - RNA, 20 nt, synthetic construct
  misc_feature 1..20: note = Description of Artificial Sequence: Synthetic oligonucleotide
  source 1..20: mol_type = other RNA
gccagagcaggtacctccaa

SEQ ID NO: 588 - RNA, 20 nt, synthetic construct
  misc_feature 1..20: note = Description of Artificial Sequence: Synthetic oligonucleotide
  source 1..20: mol_type = other RNA
tgccagagcaggtacctcca

SEQ ID NO: 589 - RNA, 20 nt, synthetic construct
  misc_feature 1..20: note = Description of Artificial Sequence: Synthetic oligonucleotide
  source 1..20: mol_type = other RNA
ctgccagagcaggtacctcc

SEQ ID NO: 590 - RNA, 20 nt, synthetic construct
  misc_feature 1..20: note = Description of Artificial Sequence: Synthetic oligonucleotide
  source 1..20: mol_type = other RNA
tctgccagagcaggtacctc

SEQ ID NO: 591 - RNA, 20 nt, synthetic construct
  misc_feature 1..20: note = Description of Artificial Sequence: Synthetic oligonucleotide
  source 1..20: mol_type = other RNA
atctgccagagcaggtacct

SEQ ID NO: 592 - RNA, 20 nt, synthetic construct
  misc_feature 1..20: note = Description of Artificial Sequence: Synthetic oligonucleotide
  source 1..20: mol_type = other RNA
ttgaaatctgccagagcagg

SEQ ID NO: 593 - RNA, 20 nt, synthetic construct
  misc_feature 1..20: note = Description of Artificial Sequence: Synthetic oligonucleotide
  source 1..20: mol_type = other RNA
cccggttgaaatctgccaga

SEQ ID NO: 594 - RNA, 20 nt, synthetic construct
  misc_feature 1..20: note = Description of Artificial Sequence: Synthetic oligonucleotide
  source 1..20: mol_type = other RNA
gcccggttgaaatctgccag

SEQ ID NO: 595 - RNA, 20 nt, synthetic construct
  misc_feature 1..20: note = Description of Artificial Sequence: Synthetic oligonucleotide
  source 1..20: mol_type = other RNA
agcccggttgaaatctgcca

SEQ ID NO: 596 - RNA, 20 nt, synthetic construct
  misc_feature 1..20: note = Description of Artificial Sequence: Synthetic oligonucleotide
  source 1..20: mol_type = other RNA
ccaagcccggttgaaatctg

SEQ ID NO: 597 - RNA, 20 nt, synthetic construct
  misc_feature 1..20: note = Description of Artificial Sequence: Synthetic oligonucleotide
  source 1..20: mol_type = other RNA
tccaagcccggttgaaatct

SEQ ID NO: 598 - RNA, 20 nt, synthetic construct
  misc_feature 1..20: note = Description of Artificial Sequence: Synthetic oligonucleotide
  source 1..20: mol_type = other RNA
gtccaagcccggttgaaatc

SEQ ID NO: 599 - RNA, 20 nt, synthetic construct
  misc_feature 1..20: note = Description of Artificial Sequence: Synthetic oligonucleotide
  source 1..20: mol_type = other RNA
tgtccaagcccggttgaaat

SEQ ID NO: 600 - RNA, 20 nt, synthetic construct
  misc_feature 1..20: note = Description of Artificial Sequence: Synthetic oligonucleotide
  source 1..20: mol_type = other RNA
ctgtccaagcccggttgaaa

SEQ ID NO: 601 - RNA, 20 nt, synthetic construct
  misc_feature 1..20: note = Description of Artificial Sequence: Synthetic oligonucleotide
  source 1..20: mol_type = other RNA
tctgtccaagcccggttgaa

SEQ ID NO: 602 - RNA, 20 nt, synthetic construct
  misc_feature 1..20: note = Description of Artificial Sequence: Synthetic oligonucleotide
  source 1..20: mol_type = other RNA
ttctgtccaagcccggttga

SEQ ID NO: 603 - RNA, 20 nt, synthetic construct
  misc_feature 1..20: note = Description of Artificial Sequence: Synthetic oligonucleotide
  source 1..20: mol_type = other RNA
gttctgtccaagcccggttg

SEQ ID NO: 604 - RNA, 20 nt, synthetic construct
  misc_feature 1..20: note = Description of Artificial Sequence: Synthetic oligonucleotide
  source 1..20: mol_type = other RNA
agttctgtccaagcccggtt

SEQ ID NO: 605 - RNA, 20 nt, synthetic construct
  misc_feature 1..20: note = Description of Artificial Sequence: Synthetic oligonucleotide
  source 1..20: mol_type = other RNA
aagttctgtccaagcccggt

SEQ ID NO: 606 - RNA, 20 nt, synthetic construct
  misc_feature 1..20: note = Description of Artificial Sequence: Synthetic oligonucleotide
  source 1..20: mol_type = other RNA
taagttctgtccaagcccgg

SEQ ID NO: 607 - RNA, 20 nt, synthetic construct
  misc_feature 1..20: note = Description of Artificial Sequence: Synthetic oligonucleotide
  source 1..20: mol_type = other RNA
gtaagttctgtccaagcccg

SEQ ID NO: 608 - RNA, 20 nt, synthetic construct
  misc_feature 1..20: note = Description of Artificial Sequence: Synthetic oligonucleotide
  source 1..20: mol_type = other RNA
ggtaagttctgtccaagccc

SEQ ID NO: 609 - RNA, 20 nt, synthetic construct
  misc_feature 1..20: note = Description of Artificial Sequence: Synthetic oligonucleotide
  source 1..20: mol_type = other RNA
cagtcggtaagttctgtcca

SEQ ID NO: 610 - RNA, 20 nt, synthetic construct
  misc_feature 1..20: note = Description of Artificial Sequence: Synthetic oligonucleotide
  source 1..20: mol_type = other RNA
ccagtcggtaagttctgtcc

SEQ ID NO: 611 - RNA, 20 nt, synthetic construct
  misc_feature 1..20: note = Description of Artificial Sequence: Synthetic oligonucleotide
  source 1..20: mol_type = other RNA
ccaccatcaccctctgtgat

SEQ ID NO: 612 - RNA, 20 nt, synthetic construct
  misc_feature 1..20: note = Description of Artificial Sequence: Synthetic oligonucleotide
  source 1..20: mol_type = other RNA
cccaccatcaccctctgtga

SEQ ID NO: 613 - RNA, 20 nt, synthetic construct
  misc_feature 1..20: note = Description of Artificial Sequence: Synthetic oligonucleotide
  source 1..20: mol_type = other RNA
cacccaccatcaccctctgt

SEQ ID NO: 614 - RNA, 20 nt, synthetic construct
  misc_feature 1..20: note = Description of Artificial Sequence: Synthetic oligonucleotide
  source 1..20: mol_type = other RNA
tcacccaccatcaccctctg

SEQ ID NO: 615 - RNA, 20 nt, synthetic construct
  misc_feature 1..20: note = Description of Artificial Sequence: Synthetic oligonucleotide
  source 1..20: mol_type = other RNA
gtcacccaccatcaccctct

SEQ ID NO: 616 - RNA, 20 nt, synthetic construct
  misc_feature 1..20: note = Description of Artificial Sequence: Synthetic oligonucleotide
  source 1..20: mol_type = other RNA
ggtcacccaccatcaccctc

SEQ ID NO: 617 - RNA, 20 nt, synthetic construct
  misc_feature 1..20: note = Description of Artificial Sequence: Synthetic oligonucleotide
  source 1..20: mol_type = other RNA
tcaagcagagaaagccagtc

SEQ ID NO: 618 - RNA, 20 nt, synthetic construct
  misc_feature 1..20: note = Description of Artificial Sequence: Synthetic oligonucleotide
  source 1..20: mol_type = other RNA
ttgatcaagcagagaaagcc

SEQ ID NO: 619 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 620 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 621 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 622 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 623 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 624 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 625 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 626 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 627 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 628 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 629 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 630 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 631 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 632 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 633 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 634 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 635 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 636 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 637 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 638 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 639 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 640 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 641 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 642 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 643 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 644 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 645 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 646 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 647 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 648 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 649 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 650 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 651 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 652 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 653 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 654 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 655 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 656 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 657 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 658 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 659 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 660 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 661 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 662 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 663 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 664 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 665 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 666 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 667 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 668 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 669 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 670 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 671 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 672 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 673 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 674 - RNA, 25 nt, synthetic construct
  misc_feature 1..25: note = Description of Artificial Sequence: Synthetic oligonucleotide
  source 1..25: mol_type = other RNA
caaagaagatggcatttctagtttg

SEQ ID NO: 675 - RNA, 20 nt, synthetic construct
  misc_feature 1..20: note = Description of Artificial Sequence: Synthetic oligonucleotide
  source 1..20: mol_type = other RNA
gcaaagaagatggcatttct

SEQ ID NO: 676 - RNA, 20 nt, synthetic construct
  misc_feature 1..20: note = Description of Artificial Sequence: Synthetic oligonucleotide
  source 1..20: mol_type = other RNA
gcaaagaagatggcatttct

SEQ ID NO: 677 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 678 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 679 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 680 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 681 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 682 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 683 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 684 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 685 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 686 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 687 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 688 - RNA, 20 nt, synthetic construct
  misc_feature 1..20: note = Description of Artificial Sequence: Synthetic oligonucleotide
  source 1..20: mol_type = other RNA
ggccaaacctcggcttacct

SEQ ID NO: 689 - RNA, 25 nt, synthetic construct
  misc_feature 1..25: note = Description of Artificial Sequence: Synthetic oligonucleotide
  source 1..25: mol_type = other RNA
ggccaaacctcggcttacctgaaat

SEQ ID NO: 690 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 691 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 692 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 693 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 694 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 695 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 696 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 697 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 698 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 699 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 700 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 701 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 702 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 703 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 704 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 705 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 706 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 707 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 708 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 709 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 710 - RNA, 20 nt, synthetic construct
  misc_feature 1..20: note = Description of Artificial Sequence: Synthetic oligonucleotide
  source 1..20: mol_type = other RNA
ggccaaacctcggcttacct

SEQ ID NO: 711 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 712 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 713 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 714 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 715 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 716 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 717 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 718 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 719 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 720 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 721 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 722 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 723 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 724 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 725 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 726 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 727 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 728 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 729 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 730 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 731 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 732 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 733 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 734 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 735 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 736 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 737 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 738 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 739 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 740 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 741 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 742 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 743 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 744 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 745 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 746 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 747 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 748 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 749 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 750 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 751 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 752 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 753 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 754 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 755 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 756 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 757 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 758 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 759 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 760 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 761 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 762 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 763 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 764 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 765 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 766 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 767 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 768 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 769 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 770 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 771 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 772 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 773 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 774 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 775 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 776 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 777 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 778 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 779 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 780 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 781 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 782 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 783 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 784 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 785 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 786 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 787 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 788 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 789 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 790 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 791 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 792 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 793 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 794 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 795 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 796 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 797 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 798 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 799 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 800 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 801 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 802 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 803 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 804 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 805 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 806 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 807 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 808 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 809 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 810 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 811 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 812 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 813 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 814 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 815 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 816 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 817 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 818 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 819 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 820 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 821 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 822 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 823 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 824 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 825 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 826 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 827 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 828 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 829 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 830 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 831 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 832 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 833 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 834 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 835 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 836 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 837 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 838 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 839 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 840 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 841 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 842 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 843 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 844 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 845 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 846 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 847 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 848 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 849 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 850 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 851 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 852 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 853 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 854 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 855 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 856 - RNA, 30 nt, synthetic construct; identical to SEQ ID NO: 259
  misc_feature 1..30: note = Description of Artificial Sequence: Synthetic oligonucleotide
  source 1..30: mol_type = other RNA

SEQ ID NO: 857 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 858 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 859 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 860 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 861 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 862 - RNA, 20 nt, synthetic construct
  misc_feature 1..20: note = Description of Artificial Sequence: Synthetic oligonucleotide
  source 1..20: mol_type = other RNA
ccttccctgaaggttcctcc

SEQ ID NO: 863 - RNA, 20 nt, synthetic construct
  misc_feature 1..20: note = Description of Artificial Sequence: Synthetic oligonucleotide
  source 1..20: mol_type = other RNA
ccttccctgaaggttcctcc

SEQ ID NO: 864 - RNA, 20 nt, synthetic construct
  misc_feature 1..20: note = Description of Artificial Sequence: Synthetic oligonucleotide
  source 1..20: mol_type = other RNA
ccttccctgaaggttcctcc

SEQ ID NO: 865 - RNA, 20 nt, synthetic construct
  misc_feature 1..20: note = Description of Artificial Sequence: Synthetic oligonucleotide
  source 1..20: mol_type = other RNA
ccttccctgaaggttcctcc

SEQ ID NO: 866 - RNA, 20 nt, synthetic construct
  misc_feature 1..20: note = Description of Artificial Sequence: Synthetic oligonucleotide
  source 1..20: mol_type = other RNA
ccttccctgaaggttcctcc

SEQ ID NO: 867 - RNA, 20 nt, synthetic construct
  misc_feature 1..20: note = Description of Artificial Sequence: Synthetic oligonucleotide
  source 1..20: mol_type = other RNA
ccttccctgaaggttcctcc

SEQ ID NO: 868 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 869 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 870 - DNA, 30 bp, synthetic construct
  misc_feature 1..30: note = Description of Artificial Sequence: Synthetic oligonucleotide
  source 1..30: mol_type = other DNA
ctccaacatcaaggaagatggcatttctag

SEQ ID NO: 871 - RNA, 24 nt, synthetic construct
  misc_feature 1..24: note = Description of Artificial Sequence: Synthetic oligonucleotide
  source 1..24: mol_type = other RNA
cccattttgtgaatgttttctttt

SEQ ID NO: 872 - RNA, 22 nt, synthetic construct
  misc_feature 1..22: note = Description of Artificial Sequence: Synthetic oligonucleotide
  source 1..22: mol_type = other RNA
ttgtgtatttacccattttgtg

SEQ ID NO: 873 - RNA, 20 nt, synthetic construct
  misc_feature 1..20: note = Description of Artificial Sequence: Synthetic oligonucleotide
  source 1..20: mol_type = other RNA
tatcctctgaatgtcgcatc

SEQ ID NO: 874 - RNA, 20 nt, synthetic construct
  misc_feature 1..20: note = Description of Artificial Sequence: Synthetic oligonucleotide
  source 1..20: mol_type = other RNA
ggttatcctctgaatgtcgc

SEQ ID NO: 875 - RNA, 19 nt, synthetic construct
  misc_feature 1..19: note = Description of Artificial Sequence: Synthetic oligonucleotide
  source 1..19: mol_type = other RNA
gagccttttttcttctttg

SEQ ID NO: 876 - RNA, 19 nt, synthetic construct
  misc_feature 1..19: note = Description of Artificial Sequence: Synthetic oligonucleotide
  source 1..19: mol_type = other RNA
tcctttcgtctctgggctc

SEQ ID NO: 877 - RNA, 19 nt, synthetic construct
  misc_feature 1..19: note = Description of Artificial Sequence: Synthetic oligonucleotide
  source 1..19: mol_type = other RNA
ctcctctttcttcttctgc

SEQ ID NO: 878 - RNA, 20 nt, synthetic construct
  misc_feature 1..20: note = Description of Artificial Sequence: Synthetic oligonucleotide
  source 1..20: mol_type = other RNA
cttcgaaactgagcaaattt

SEQ ID NO: 879 - RNA, 17 nt, synthetic construct
  misc_feature 1..17: note = Description of Artificial Sequence: Synthetic oligonucleotide
  source 1..17: mol_type = other RNA
cttgtgagacatgagtg

SEQ ID NO: 880 - RNA, 18 nt, synthetic construct
  misc_feature 1..18: note = Description of Artificial Sequence: Synthetic oligonucleotide
  source 1..18: mol_type = other RNA
cagagactcctcttgctt

SEQ ID NO: 881 - RNA, 18 nt, synthetic construct
  misc_feature 1..18: note = Description of Artificial Sequence: Synthetic oligonucleotide
  source 1..18: mol_type = other RNA
tgctgctgtcttcttgct

SEQ ID NO: 882 - RNA, 19 nt, synthetic construct
  misc_feature 1..19: note = Description of Artificial Sequence: Synthetic oligonucleotide
  source 1..19: mol_type = other RNA
ttgttaactttttcccatt

SEQ ID NO: 883 - RNA, 19 nt, synthetic construct
  misc_feature 1..19: note = Description of Artificial Sequence: Synthetic oligonucleotide
  source 1..19: mol_type = other RNA
cgccgccatttctcaacag

SEQ ID NO: 884 - DNA, 15 bp, synthetic construct
  misc_feature 1..15: note = Description of Artificial Sequence: Synthetic oligonucleotide
  source 1..15: mol_type = other DNA
tagatagctatatat

SEQ ID NO: 885 - DNA, 15 bp, synthetic construct
  misc_feature 1..15: note = Description of Artificial Sequence: Synthetic oligonucleotide
  source 1..15: mol_type = other DNA
atagatagctatata

SEQ ID NO: 886 - DNA, 15 bp, synthetic construct
  misc_feature 1..15: note = Description of Artificial Sequence: Synthetic oligonucleotide
  source 1..15: mol_type = other DNA
tatagatagctatat

SEQ ID NO: 887 - DNA, 15 bp, synthetic construct
  misc_feature 1..15: note = Description of Artificial Sequence: Synthetic oligonucleotide
  source 1..15: mol_type = other DNA
atatagatagctata

SEQ ID NO: 888 - DNA, 15 bp, synthetic construct
  misc_feature 1..15: note = Description of Artificial Sequence: Synthetic oligonucleotide
  source 1..15: mol_type = other DNA
gatatagatagctat

SEQ ID NO: 889 - DNA, 12 bp, synthetic construct
  misc_feature 1..12: note = Description of Artificial Sequence: Synthetic oligonucleotide
  source 1..12: mol_type = other DNA
atagatagctat

SEQ ID NO: 890 - DNA, 15 bp, synthetic construct
  misc_feature 1..15: note = Description of Artificial Sequence: Synthetic oligonucleotide
  source 1..15: mol_type = other DNA
agatatagatagcta

SEQ ID NO: 891 - DNA, 12 bp, synthetic construct
  misc_feature 1..12: note = Description of Artificial Sequence: Synthetic oligonucleotide
  source 1..12: mol_type = other DNA
tatagatagcta

SEQ ID NO: 892 - DNA, 15 bp, synthetic construct
  misc_feature 1..15: note = Description of Artificial Sequence: Synthetic oligonucleotide
  source 1..15: mol_type = other DNA
tagatatagatagct

SEQ ID NO: 893 - DNA, 12 bp, synthetic construct
  misc_feature 1..12: note = Description of Artificial Sequence: Synthetic oligonucleotide
  source 1..12: mol_type = other DNA
atatagatagct

SEQ ID NO: 894 - DNA, 15 bp, synthetic construct
  misc_feature 1..15: note = Description of Artificial Sequence: Synthetic oligonucleotide
  source 1..15: mol_type = other DNA
atagatatagatagc

SEQ ID NO: 895 - DNA, 12 bp, synthetic construct
  misc_feature 1..12: note = Description of Artificial Sequence: Synthetic oligonucleotide
  source 1..12: mol_type = other DNA
gatatagatagc

SEQ ID NO: 896 - DNA, 15 bp, synthetic construct
  misc_feature 1..15: note = Description of Artificial Sequence: Synthetic oligonucleotide
  source 1..15: mol_type = other DNA
tatagatatagatag

SEQ ID NO: 897 - DNA, 12 bp, synthetic construct
  misc_feature 1..12: note = Description of Artificial Sequence: Synthetic oligonucleotide
  source 1..12: mol_type = other DNA
agatatagatag

SEQ ID NO: 898 - DNA, 15 bp, synthetic construct
  misc_feature 1..15: note = Description of Artificial Sequence: Synthetic oligonucleotide
  source 1..15: mol_type = other DNA
atatagatatagata

SEQ ID NO: 899 - DNA, 12 bp, synthetic construct
  misc_feature 1..12: note = Description of Artificial Sequence: Synthetic oligonucleotide
  source 1..12: mol_type = other DNA
tagatatagata

SEQ ID NO: 900 - DNA, 15 bp, synthetic construct
  misc_feature 1..15: note = Description of Artificial Sequence: Synthetic oligonucleotide
  source 1..15: mol_type = other DNA
tatatagatatagat

SEQ ID NO: 901 - DNA, 12 bp, synthetic construct
  misc_feature 1..12: note = Description of Artificial Sequence: Synthetic oligonucleotide
  source 1..12: mol_type = other DNA
atagatatagat

SEQ ID NO: 902 - DNA, 12 bp, synthetic construct
  misc_feature 1..12: note = Description of Artificial Sequence: Synthetic oligonucleotide
  source 1..12: mol_type = other DNA
tatagatataga

SEQ ID NO: 903 - DNA, 12 bp, synthetic construct
  misc_feature 1..12: note = Description of Artificial Sequence: Synthetic oligonucleotide
  source 1..12: mol_type = other DNA
atatagatatag

SEQ ID NO: 904 - DNA, 15 bp, synthetic construct
  misc_feature 1..15: note = Description of Artificial Sequence: Synthetic oligonucleotide
  source 1..15: mol_type = other DNA
atagctatatagata

SEQ ID NO: 905 - DNA, 15 bp, synthetic construct
  misc_feature 1..15: note = Description of Artificial Sequence: Synthetic oligonucleotide
  source 1..15: mol_type = other DNA
aaaaaatagctatat

SEQ ID NO: 906 - DNA, 15 bp, synthetic construct
  misc_feature 1..15: note = Description of Artificial Sequence: Synthetic oligonucleotide
  source 1..15: mol_type = other DNA
gttaaaaaaaatagc

SEQ ID NO: 907 - DNA, 15 bp, synthetic construct
  misc_feature 1..15: note = Description of Artificial Sequence: Synthetic oligonucleotide
  source 1..15: mol_type = other DNA
aggaagttaaaaaaa

SEQ ID NO: 908 - DNA, 15 bp, synthetic construct
  misc_feature 1..15: note = Description of Artificial Sequence: Synthetic oligonucleotide
  source 1..15: mol_type = other DNA
aataaaggaagttaa

SEQ ID NO: 909 - DNA, 15 bp, synthetic construct
  misc_feature 1..15: note = Description of Artificial Sequence: Synthetic oligonucleotide
  source 1..15: mol_type = other DNA
aggaaaataaaggaa

SEQ ID NO: 910 - DNA, 15 bp, synthetic construct
  misc_feature 1..15: note = Description of Artificial Sequence: Synthetic oligonucleotide
  source 1..15: mol_type = other DNA
gtgtaaggaaaataa

SEQ ID NO: 911 - DNA, 15 bp, synthetic construct
  misc_feature 1..15: note = Description of Artificial Sequence: Synthetic oligonucleotide
  source 1..15: mol_type = other DNA
attttgtctaaaacc

SEQ ID NO: 912 - DNA, 15 bp, synthetic construct
  misc_feature 1..15: note = Description of Artificial Sequence: Synthetic oligonucleotide
  source 1..15: mol_type = other DNA
gattttgtctaaaac

SEQ ID NO: 913 - DNA, 12 bp, synthetic construct
  misc_feature 1..12: note = Description of Artificial Sequence: Synthetic oligonucleotide
  source 1..12: mol_type = other DNA
ttttgtctaaaa

SEQ ID NO: 914 - DNA, 15 bp, synthetic construct
  misc_feature 1..15: note = Description of Artificial Sequence: Synthetic oligonucleotide
  source 1..15: mol_type = other DNA
tgattttgtctaaaa

SEQ ID NO: 915 - DNA, 12 bp, synthetic construct
  misc_feature 1..12: note = Description of Artificial Sequence: Synthetic oligonucleotide
  source 1..12: mol_type = other DNA
attttgtctaaa

SEQ ID NO: 916 - DNA, 15 bp, synthetic construct
  misc_feature 1..15: note = Description of Artificial Sequence: Synthetic oligonucleotide
  source 1..15: mol_type = other DNA
ttgattttgtctaaa

SEQ ID NO: 917 - DNA, 13 bp, synthetic construct
  misc_feature 1..13: note = Description of Artificial Sequence: Synthetic oligonucleotide
  source 1..13: mol_type = other DNA
gatttttgtctaa

SEQ ID NO: 918 - DNA, 15 bp, synthetic construct
  misc_feature 1..15: note = Description of Artificial Sequence: Synthetic oligonucleotide
  source 1..15: mol_type = other DNA
tttgattttgtctaa

SEQ ID NO: 919 - DNA, 16 bp, synthetic construct
  misc_feature 1..16: note = Description of Artificial Sequence: Synthetic oligonucleotide
  source 1..16: mol_type = other DNA
ttttgattttgtctaa

SEQ ID NO: 920 - DNA, 15 bp, synthetic construct
  misc_feature 1..15: note = Description of Artificial Sequence: Synthetic oligonucleotide
  source 1..15: mol_type = other DNA
ttttgattttgtcta

SEQ ID NO: 921 - DNA, 12 bp, synthetic construct
  misc_feature 1..12: note = Description of Artificial Sequence: Synthetic oligonucleotide
  source 1..12: mol_type = other DNA
tgattttgtcta

SEQ ID NO: 922 - DNA, 12 bp, synthetic construct
  misc_feature 1..12: note = Description of Artificial Sequence: Synthetic oligonucleotide
  source 1..12: mol_type = other DNA
ttgattttgtct

SEQ ID NO: 923 - DNA, 15 bp, synthetic construct
  misc_feature 1..15: note = Description of Artificial Sequence: Synthetic oligonucleotide
  source 1..15: mol_type = other DNA
tttttgattttgtct

SEQ ID NO: 924 - DNA, 12 bp, synthetic construct
  misc_feature 1..12: note = Description of Artificial Sequence: Synthetic oligonucleotide
  source 1..12: mol_type = other DNA
tttgattttgtc

SEQ ID NO: 925 - DNA, 15 bp, synthetic construct
  misc_feature 1..15: note = Description of Artificial Sequence: Synthetic oligonucleotide
  source 1..15: mol_type = other DNA
ctttttgattttgtc

SEQ ID NO: 926 - DNA, 12 bp, synthetic construct
  misc_feature 1..12: note = Description of Artificial Sequence: Synthetic oligonucleotide
  source 1..12: mol_type = other DNA
ttttgattttgt

SEQ ID NO: 927 - DNA, 12 bp, synthetic construct
  misc_feature 1..12: note = Description of Artificial Sequence: Synthetic oligonucleotide
  source 1..12: mol_type = other DNA
tttttgattttg

SEQ ID NO: 928 - DNA, 15 bp, synthetic construct
  misc_feature 1..15: note = Description of Artificial Sequence: Synthetic oligonucleotide
  source 1..15: mol_type = other DNA
cttctttttgatttt

SEQ ID NO: 929 - DNA, 12 bp, synthetic construct
  misc_feature 1..12: note = Description of Artificial Sequence: Synthetic oligonucleotide
  source 1..12: mol_type = other DNA
ctttttgatttt

SEQ ID NO: 930 - DNA, 12 bp, synthetic construct
  misc_feature 1..12: note = Description of Artificial Sequence: Synthetic oligonucleotide
  source 1..12: mol_type = other DNA
tctttttgattt

SEQ ID NO: 931 - DNA, 15 bp, synthetic construct
  misc_feature 1..15: note = Description of Artificial Sequence: Synthetic oligonucleotide
  source 1..15: mol_type = other DNA
ccttccttctttttg

SEQ ID NO: 932 - DNA, 15 bp, synthetic construct
  misc_feature 1..15: note = Description of Artificial Sequence: Synthetic oligonucleotide
  source 1..15: mol_type = other DNA
gagcaccttccttct

SEQ ID NO: 933 - DNA, 15 bp, synthetic construct
  misc_feature 1..15: note = Description of Artificial Sequence: Synthetic oligonucleotide
  source 1..15: mol_type = other DNA
aatgtgagcaccttc

SEQ ID NO: 934 - DNA, 15 bp, synthetic construct
  misc_feature 1..15: note = Description of Artificial Sequence: Synthetic oligonucleotide
  source 1..15: mol_type = other DNA
taaggaatgtgagca

SEQ ID NO: 935 - DNA, 18 bp, synthetic construct
  misc_feature 1..18: note = Description of Artificial Sequence: Synthetic oligonucleotide
  source 1..18: mol_type = other DNA
aatttaaggaatgtgagc

SEQ ID NO: 936 - DNA, 15 bp, synthetic construct
  misc_feature 1..15: note = Description of Artificial Sequence: Synthetic oligonucleotide
  source 1..15: mol_type = other DNA
ttaaggaatgtgagc

SEQ ID NO: 937 - DNA, 18 bp, synthetic construct
  misc_feature 1..18: note = Description of Artificial Sequence: Synthetic oligonucleotide
  source 1..18: mol_type = other DNA
taatttaaggaatgtgag

SEQ ID NO: 938 - DNA, 15 bp, synthetic construct
  misc_feature 1..15: note = Description of Artificial Sequence: Synthetic oligonucleotide
  source 1..15: mol_type = other DNA
tttaaggaatgtgag

SEQ ID NO: 939 - DNA, 12 bp, synthetic construct
  misc_feature 1..12: note = Description of Artificial Sequence: Synthetic oligonucleotide
  source 1..12: mol_type = other DNA
aaggaatgtgag

SEQ ID NO: 940 - DNA, 18 bp, synthetic construct
  misc_feature 1..18: note = Description of Artificial Sequence: Synthetic oligonucleotide
  source 1..18: mol_type = other DNA
ttaatttaaggaatgtga

SEQ ID NO: 941 - DNA, 15 bp, synthetic construct
  misc_feature 1..15: note = Description of Artificial Sequence: Synthetic oligonucleotide
  source 1..15: mol_type = other DNA
atttaaggaatgtga

SEQ ID NO: 942 - DNA, 12 bp, synthetic construct
  misc_feature 1..12: note = Description of Artificial Sequence: Synthetic oligonucleotide
  source 1..12: mol_type = other DNA
taaggaatgtga

SEQ ID NO: 943 - DNA, 18 bp, synthetic construct
  misc_feature 1..18: note = Description of Artificial Sequence: Synthetic oligonucleotide
  source 1..18: mol_type = other DNA
cttaatttaaggaatgtg

SEQ ID NO: 944 - DNA, 15 bp, synthetic construct
  misc_feature 1..15: note = Description of Artificial Sequence: Synthetic oligonucleotide
  source 1..15: mol_type = other DNA
aatttaaggaatgtg

SEQ ID NO: 945 - DNA, 12 bp, synthetic construct
  misc_feature 1..12: note = Description of Artificial Sequence: Synthetic oligonucleotide
  source 1..12: mol_type = other DNA
ttaaggaatgtg

SEQ ID NO: 946 - DNA, 15 bp, synthetic construct
  misc_feature 1..15: note = Description of Artificial Sequence: Synthetic oligonucleotide
  source 1..15: mol_type = other DNA
taatttaaggaatgt

SEQ ID NO: 947 - DNA, 18 bp, synthetic construct
  misc_feature 1..18: note = Description of Artificial Sequence: Synthetic oligonucleotide
  source 1..18: mol_type = other DNA
ccttaatttaaggaatgt

SEQ ID NO: 948 - DNA, 12 bp, synthetic construct
  misc_feature 1..12: note = Description of Artificial Sequence: Synthetic oligonucleotide
  source 1..12: mol_type = other DNA
tttaaggaatgt

SEQ ID NO: 949 - DNA, 15 bp, synthetic construct
  misc_feature 1..15: note = Description of Artificial Sequence: Synthetic oligonucleotide
  source 1..15: mol_type = other DNA
ttaatttaaggaatg

SEQ ID NO: 950 - DNA, 12 bp, synthetic construct
  misc_feature 1..12: note = Description of Artificial Sequence: Synthetic oligonucleotide
  source 1..12: mol_type = other DNA
atttaaggaatg

SEQ ID NO: 951 - DNA, 15 bp, synthetic construct
  misc_feature 1..15: note = Description of Artificial Sequence: Synthetic oligonucleotide
  source 1..15: mol_type = other DNA
cttaatttaaggaat

SEQ ID NO: 952 - DNA, 12 bp, synthetic construct
  misc_feature 1..12: note = Description of Artificial Sequence: Synthetic oligonucleotide
  source 1..12: mol_type = other DNA
aatttaaggaat

SEQ ID NO: 953 - DNA, 15 bp, synthetic construct
  misc_feature 1..15: note = Description of Artificial Sequence: Synthetic oligonucleotide
  source 1..15: mol_type = other DNA
ccttaatttaaggaa

SEQ ID NO: 954 - DNA, 12 bp, synthetic construct
  misc_feature 1..12: note = Description of Artificial Sequence: Synthetic oligonucleotide
  source 1..12: mol_type = other DNA
taatttaaggaa

SEQ ID NO: 955 - DNA, 15 bp, synthetic construct
  misc_feature 1..15: note = Description of Artificial Sequence: Synthetic oligonucleotide
  source 1..15: mol_type = other DNA
tccttaatttaagga

SEQ ID NO: 956 - DNA, 12 bp, synthetic construct
  misc_feature 1..12: note = Description of Artificial Sequence: Synthetic oligonucleotide
  source 1..12: mol_type = other DNA
ttaatttaagga

SEQ ID NO: 957 - DNA, 12 bp, synthetic construct
  misc_feature 1..12: note = Description of Artificial Sequence: Synthetic oligonucleotide
  source 1..12: mol_type = other DNA
cttaatttaagg

SEQ ID NO: 958 - DNA, 12 bp, synthetic construct
  misc_feature 1..12: note = Description of Artificial Sequence: Synthetic oligonucleotide
  source 1..12: mol_type = other DNA
ccttaatttaag

SEQ ID NO: 959 - DNA, 15 bp, synthetic construct
  misc_feature 1..15: note = Description of Artificial Sequence: Synthetic oligonucleotide
  source 1..15: mol_type = other DNA
tgctggcagacttac

SEQ ID NO: 960 - DNA, 15 bp, synthetic construct
  misc_feature 1..15: note = Description of Artificial Sequence: Synthetic oligonucleotide
  source 1..15: mol_type = other DNA
cataatgctggcaga

SEQ ID NO: 961 - DNA, 15 bp, synthetic construct
  misc_feature 1..15: note = Description of Artificial Sequence: Synthetic oligonucleotide
  source 1..15: mol_type = other DNA
tcataatgctggcag

SEQ ID NO: 962 - DNA, 15 bp, synthetic construct
  misc_feature 1..15: note = Description of Artificial Sequence: Synthetic oligonucleotide
  source 1..15: mol_type = other DNA
ttcataatgctggca

SEQ ID NO: 963 - DNA, 15 bp, synthetic construct
  misc_feature 1..15: note = Description of Artificial Sequence: Synthetic oligonucleotide
  source 1..15: mol_type = other DNA
tttcataatgctggc

SEQ ID NO: 964 - DNA, 20 bp, synthetic construct
  misc_feature 1..20: note = Description of Artificial Sequence: Synthetic oligonucleotide
  source 1..20: mol_type = other DNA
attcactttcataatgctgg

SEQ ID NO: 965 - DNA, 15 bp, synthetic construct
  misc_feature 1..15: note = Description of Artificial Sequence: Synthetic oligonucleotide
  source 1..15: mol_type = other DNA
ctttcataatgctgg

SEQ ID NO: 966 - DNA, 12 bp, synthetic construct
  misc_feature 1..12: note = Description of Artificial Sequence: Synthetic oligonucleotide
  source 1..12: mol_type = other DNA
tcataatgctgg

SEQ ID NO: 967 - DNA, 15 bp, synthetic construct
  misc_feature 1..15: note = Description of Artificial Sequence: Synthetic oligonucleotide
  source 1..15: mol_type = other DNA
actttcataatgctg

SEQ ID NO: 968 - DNA, 12 bp, synthetic construct
  misc_feature 1..12: note = Description of Artificial Sequence: Synthetic oligonucleotide
  source 1..12: mol_type = other DNA
ttcataatgctg

SEQ ID NO: 969 - DNA, 15 bp, synthetic construct
  misc_feature 1..15: note = Description of Artificial Sequence: Synthetic oligonucleotide
  source 1..15: mol_type = other DNA
cactttcataatgct

SEQ ID NO: 970 - DNA, 12 bp, synthetic construct
  misc_feature 1..12: note = Description of Artificial Sequence: Synthetic oligonucleotide
  source 1..12: mol_type = other DNA
tttcataatgct

SEQ ID NO: 971 - DNA, 15 bp, synthetic construct
  misc_feature 1..15: note = Description of Artificial Sequence: Synthetic oligonucleotide
  source 1..15: mol_type = other DNA
tcactttcataatgc

SEQ ID NO: 972 - DNA, 12 bp, synthetic construct
  misc_feature 1..12: note = Description of Artificial Sequence: Synthetic oligonucleotide
  source 1..12: mol_type = other DNA
gtttcataatgc

SEQ ID NO: 973 - DNA, 15 bp, synthetic construct
  misc_feature 1..15: note = Description of Artificial Sequence: Synthetic oligonucleotide
  source 1..15: mol_type = other DNA
ttcactttcataatg

SEQ ID NO: 974 - DNA, 12 bp, synthetic construct
  misc_feature 1..12: note = Description of Artificial Sequence: Synthetic oligonucleotide
  source 1..12: mol_type = other DNA
actttcataatg

SEQ ID NO: 975 - DNA, 15 bp, synthetic construct
  misc_feature 1..15: note = Description of Artificial Sequence: Synthetic oligonucleotide
  source 1..15: mol_type = other DNA
attcactttcataat

SEQ ID NO: 976 - DNA, 12 bp, synthetic construct
  misc_feature 1..12: note = Description of Artificial Sequence: Synthetic oligonucleotide
  source 1..12: mol_type = other DNA
cactttcataat

SEQ ID NO: 977 - DNA, 15 bp, synthetic construct
  misc_feature 1..15: note = Description of Artificial Sequence: Synthetic oligonucleotide
  source 1..15: mol_type = other DNA
gattcactttcataa

SEQ ID NO: 978 - DNA, 12 bp, synthetic construct
  misc_feature 1..12: note = Description of Artificial Sequence: Synthetic oligonucleotide
  source 1..12: mol_type = other DNA
tcactttcataa

SEQ ID NO: 979 - DNA, 12 bp, synthetic construct
  misc_feature 1..12: note = Description of Artificial Sequence: Synthetic oligonucleotide
  source 1..12: mol_type = other DNA
ttcactttcata

SEQ ID NO: 980 - DNA, 12 bp, synthetic construct
  misc_feature 1..12: note = Description of Artificial Sequence: Synthetic oligonucleotide
  source 1..12: mol_type = other DNA
attcactttcat

SEQ ID NO: 981 - DNA, 15 bp, synthetic construct
  misc_feature 1..15: note = Description of Artificial Sequence: Synthetic oligonucleotide
  source 1..15: mol_type = other DNA
agtaagattcacttt

SEQ ID NO: 982 - DNA, 15 bp, synthetic construct
  misc_feature 1..15: note = Description of Artificial Sequence: Synthetic oligonucleotide
  source 1..15: mol_type = other DNA
acaaaagtaagattc

SEQ ID NO: 983 - DNA, 15 bp, synthetic construct
  misc_feature 1..15: note = Description of Artificial Sequence: Synthetic oligonucleotide
  source 1..15: mol_type = other DNA
gttttacaaaagtaa

SEQ ID NO: 984 - DNA, 15 bp, synthetic construct
  misc_feature 1..15: note = Description of Artificial Sequence: Synthetic oligonucleotide
  source 1..15: mol_type = other DNA
ataaagttttacaaa

SEQ ID NO: 985 - DNA, 15 bp, synthetic construct
  misc_feature 1..15: note = Description of Artificial Sequence: Synthetic oligonucleotide
  source 1..15: mol_type = other DNA
aaaccataaagtttt

SEQ ID NO: 986 - DNA, 15 bp, synthetic construct
  misc_feature 1..15: note = Description of Artificial Sequence: Synthetic oligonucleotide
  source 1..15: mol_type = other DNA
tccacaaaccataaa

SEQ ID NO: 987 - DNA, 20 bp, synthetic construct
  misc_feature 1..20: note = Description of Artificial Sequence: Synthetic oligonucleotide
  source 1..20: mol_type = other DNA
attcactttcataatgctgg

SEQ ID NO: 988 - DNA, 20 bp, synthetic construct
  misc_feature 1..20: note = Description of Artificial Sequence: Synthetic oligonucleotide
  source 1..20: mol_type = other DNA
attcactttcataatgctgg

SEQ ID NO: 989 - DNA, 20 bp, synthetic construct
  misc_feature 1..20: note = Description of Artificial Sequence: Synthetic oligonucleotide
  source 1..20: mol_type = other DNA
attcactttcataatgctgg

SEQ ID NO: 990 - DNA, 20 bp, synthetic construct
  misc_feature 1..20: note = Description of Artificial Sequence: Synthetic oligonucleotide
  source 1..20: mol_type = other DNA
attcactttcataatgctgg

SEQ ID NO: 991 - DNA, 20 bp, synthetic construct
  misc_feature 1..20: note = Description of Artificial Sequence: Synthetic oligonucleotide
  source 1..20: mol_type = other DNA
attcactttcataatgctgg

SEQ ID NO: 992 - DNA, 20 bp, synthetic construct
  misc_feature 1..20: note = Description of Artificial Sequence: Synthetic oligonucleotide
  source 1..20: mol_type = other DNA
attcactttcataatgctgg

SEQ ID NO: 993 - DNA, 20 bp, synthetic construct
  misc_feature 1..20: note = Description of Artificial Sequence: Synthetic oligonucleotide
  source 1..20: mol_type = other DNA
attcactttcataatgctgg

SEQ ID NO: 994 - DNA, 20 bp, synthetic construct
  misc_feature 1..20: note = Description of Artificial Sequence: Synthetic oligonucleotide
  source 1..20: mol_type = other DNA
attcactttcataatgctgg

SEQ ID NO: 995 - DNA, 17 bp, synthetic construct
  misc_feature 1..17: note = Description of Artificial Sequence: Synthetic oligonucleotide
  source 1..17: mol_type = other DNA
cactttcataatgctgg

SEQ ID NO: 996 - DNA, 17 bp, synthetic construct
  misc_feature 1..17: note = Description of Artificial Sequence: Synthetic oligonucleotide
  source 1..17: mol_type = other DNA
cactttcataatgctgg

SEQ ID NO: 997 - DNA, 17 bp, synthetic construct
  misc_feature 1..17: note = Description of Artificial Sequence: Synthetic oligonucleotide
  source 1..17: mol_type = other DNA
cactttcataatgctgg

SEQ ID NO: 998 - DNA, 17 bp, synthetic construct
  misc_feature 1..17: note = Description of Artificial Sequence: Synthetic oligonucleotide
  source 1..17: mol_type = other DNA
cactttcataatgctgg

SEQ ID NO: 999 - DNA, 17 bp, synthetic construct
  misc_feature 1..17: note = Description of Artificial Sequence: Synthetic oligonucleotide
  source 1..17: mol_type = other DNA
cactttcataatgctgg

SEQ ID NO: 1000 - DNA, 17 bp, synthetic construct
  misc_feature 1..17: note = Description of Artificial Sequence: Synthetic oligonucleotide
  source 1..17: mol_type = other DNA
cactttcataatgctgg

SEQ ID NO: 1001 - DNA, 17 bp, synthetic construct
  misc_feature 1..17: note = Description of Artificial Sequence: Synthetic oligonucleotide
  source 1..17: mol_type = other DNA
cactttcataatgctgg

SEQ ID NO: 1002 - DNA, 17 bp, synthetic construct
  misc_feature 1..17: note = Description of Artificial Sequence: Synthetic oligonucleotide
  source 1..17: mol_type = other DNA
cactttcataatgctgg

SEQ ID NO: 1003 - DNA, 17 bp, synthetic construct
  misc_feature 1..17: note = Description of Artificial Sequence: Synthetic oligonucleotide
  source 1..17: mol_type = other DNA
cactttcataatgctgg

SEQ ID NO: 1004 - DNA, 17 bp, synthetic construct
  misc_feature 1..17: note = Description of Artificial Sequence: Synthetic oligonucleotide
  source 1..17: mol_type = other DNA
cactttcataatgctgg

SEQ ID NO: 1005 - DNA, 14 bp, synthetic construct
  misc_feature 1..14: note = Description of Artificial Sequence: Synthetic oligonucleotide
  source 1..14: mol_type = other DNA
tttcataatgctgg

SEQ ID NO: 1006 - DNA, 14 bp, synthetic construct
  misc_feature 1..14: note = Description of Artificial Sequence: Synthetic oligonucleotide
  source 1..14: mol_type = other DNA
tttcataatgctgg

SEQ ID NO: 1007 - DNA, 14 bp, synthetic construct
  misc_feature 1..14: note = Description of Artificial Sequence: Synthetic oligonucleotide
  source 1..14: mol_type = other DNA
tttcataatgctgg

SEQ ID NO: 1008 - DNA, 14 bp, synthetic construct
  misc_feature 1..14: note = Description of Artificial Sequence: Synthetic oligonucleotide
  source 1..14: mol_type = other DNA
tttcataatgctgg

SEQ ID NO: 1009 - DNA, 14 bp, synthetic construct
  misc_feature 1..14: note = Description of Artificial Sequence: Synthetic oligonucleotide
  source 1..14: mol_type = other DNA
tttcataatgctgg

SEQ ID NO: 1010 - DNA, 14 bp, synthetic construct
  misc_feature 1..14: note = Description of Artificial Sequence: Synthetic oligonucleotide
  source 1..14: mol_type = other DNA
tttcataatgctgg

SEQ ID NO: 1011 - DNA, 14 bp, synthetic construct
  misc_feature 1..14: note = Description of Artificial Sequence: Synthetic oligonucleotide
  source 1..14: mol_type = other DNA
tttcataatgctgg

SEQ ID NO: 1012 - DNA, 11 bp, synthetic construct
  misc_feature 1..11: note = Description of Artificial Sequence: Synthetic oligonucleotide
  source 1..11: mol_type = other DNA
aatgctggcag

SEQ ID NO: 1013 - DNA, 11 bp, synthetic construct
  misc_feature 1..11: note = Description of Artificial Sequence: Synthetic oligonucleotide
  source 1..11: mol_type = other DNA
aatgctggcag

SEQ ID NO: 1014 - DNA, 11 bp, synthetic construct
  misc_feature 1..11: note = Description of Artificial Sequence: Synthetic oligonucleotide
  source 1..11: mol_type = other DNA
aatgctggcag

SEQ ID NO: 1015 - DNA, 11 bp, synthetic construct
  misc_feature 1..11: note = Description of Artificial Sequence: Synthetic oligonucleotide
  source 1..11: mol_type = other DNA
aatgctggcag

SEQ ID NO: 1016 - DNA, 11 bp, synthetic construct
  misc_feature 1..11: note = Description of Artificial Sequence: Synthetic oligonucleotide
  source 1..11: mol_type = other DNA
aatgctggcag

SEQ ID NO: 1017 - DNA, 11 bp, synthetic construct
  misc_feature 1..11: note = Description of Artificial Sequence: Synthetic oligonucleotide
  source 1..11: mol_type = other DNA
aatgctggcag

SEQ ID NO: 1018 - DNA, 11 bp, synthetic construct
  misc_feature 1..11: note = Description of Artificial Sequence: Synthetic oligonucleotide
  source 1..11: mol_type = other DNA
aatgctggcag

SEQ ID NO: 1019-1027 - skipped (9 entries)

SEQ ID NO: 1028 - DNA, 21 bp, synthetic construct
  misc_feature 1..21: note = Description of Artificial Sequence: Synthetic oligonucleotide
  source 1..21: mol_type = other DNA
ctagtatttcctgcaaatgag

SEQ ID NO: 1029 - DNA, 21 bp, synthetic construct
  misc_feature 1..21: note = Description of Artificial Sequence: Synthetic oligonucleotide
  source 1..21: mol_type = other DNA
ctagtatttcctgcaaatgag

SEQ ID NO: 1030 - DNA, 21 bp, synthetic construct
  misc_feature 1..21: note = Description of Artificial Sequence: Synthetic oligonucleotide
  source 1..21: mol_type = other DNA
ctagtatttcctgcaaatgag

SEQ ID NO: 1031 - DNA, 21 bp, synthetic construct
  misc_feature 1..21: note = Description of Artificial Sequence: Synthetic oligonucleotide
  source 1..21: mol_type = other DNA
ctagtatttcctgcaaatgag

SEQ ID NO: 1032 - DNA, 21 bp, synthetic construct
  misc_feature 1..21: note = Description of Artificial Sequence: Synthetic oligonucleotide
  source 1..21: mol_type = other DNA
ctagtatttcctgcaaatgag

SEQ ID NO: 1033 - DNA, 21 bp, synthetic construct
  misc_feature 1..21: note = Description of Artificial Sequence: Synthetic oligonucleotide
  source 1..21: mol_type = other DNA
ctagtatttcctgcaaatgag

SEQ ID NO: 1034 - DNA, 21 bp, synthetic construct
  misc_feature 1..21: note = Description of Artificial Sequence: Synthetic oligonucleotide
  source 1..21: mol_type = other DNA
ctagtatttcctgcaaatgag

SEQ ID NO: 1035 - DNA, 21 bp, synthetic construct
  misc_feature 1..21: note = Description of Artificial Sequence: Synthetic oligonucleotide
  source 1..21: mol_type = other DNA
ctagtatttcctgcaaatgag

SEQ ID NO: 1036 - DNA, 21 bp, synthetic construct
  misc_feature 1..21: note = Description of Artificial Sequence: Synthetic oligonucleotide
  source 1..21: mol_type = other DNA
ctagtatttcctgcaaatgag

SEQ ID NO: 1037 - DNA, 21 bp, synthetic construct
  misc_feature 1..21: note = Description of Artificial Sequence: Synthetic oligonucleotide
  source 1..21: mol_type = other DNA
ctagtatttcctgcaaatgag

SEQ ID NO: 1038 - DNA, 21 bp, synthetic construct
  misc_feature 1..21: note = Description of Artificial Sequence: Synthetic oligonucleotide
  source 1..21: mol_type = other DNA
ctagtatttcctgcaaatgag

SEQ ID NO: 1039 - DNA, 21 bp, synthetic construct
  misc_feature 1..21: note = Description of Artificial Sequence: Synthetic oligonucleotide
  source 1..21: mol_type = other DNA
ccagcatttcctgcaaatgag

SEQ ID NO: 1040 - DNA, 21 bp, synthetic construct
  misc_feature 1..21: note = Description of Artificial Sequence: Synthetic oligonucleotide
  source 1..21: mol_type = other DNA
ccagcatttcctgcaaatgag

SEQ ID NO: 1041 - DNA, 21 bp, synthetic construct
  misc_feature 1..21: note = Description of Artificial Sequence: Synthetic oligonucleotide
  source 1..21: mol_type = other DNA
ccagcatttcctgcaaatgag

SEQ ID NO: 1042 - DNA, 21 bp, synthetic construct
  misc_feature 1..21: note = Description of Artificial Sequence: Synthetic oligonucleotide
  source 1..21: mol_type = other DNA
ccagcatttcctgcaaatgag

SEQ ID NO: 1043 - DNA, 21 bp, synthetic construct
  misc_feature 1..21: note = Description of Artificial Sequence: Synthetic oligonucleotide
  source 1..21: mol_type = other DNA
ccagcatttcctgcaaatgag

SEQ ID NO: 1044 - DNA, 21 bp, synthetic construct
  misc_feature 1..21: note = Description of Artificial Sequence: Synthetic oligonucleotide
  source 1..21: mol_type = other DNA
ccagcatttcctgcaaatgag

SEQ ID NO: 1045 - DNA, 21 bp, synthetic construct
  misc_feature 1..21: note = Description of Artificial Sequence: Synthetic oligonucleotide
  source 1..21: mol_type = other DNA
ccagcatttcctgcaaatgag

SEQ ID NO: 1046 - DNA, 21 bp, synthetic construct
  misc_feature 1..21: note = Description of Artificial Sequence: Synthetic oligonucleotide
  source 1..21: mol_type = other DNA
ccagcatttcctgcaaatgag

SEQ ID NO: 1047 - DNA, 21 bp, synthetic construct
  misc_feature 1..21: note = Description of Artificial Sequence: Synthetic oligonucleotide
  source 1..21: mol_type = other DNA
ccagcatttcctgcaaatgag

SEQ ID NO: 1048 - DNA, 25 bp, synthetic construct
  misc_feature 1..25: note = Description of Artificial Sequence: Synthetic oligonucleotide
  source 1..25: mol_type = other DNA
atgccagcatttcctgcaaatgaga

SEQ ID NO: 1049 - DNA, 25 bp, synthetic construct
  misc_feature 1..25: note = Description of Artificial Sequence: Synthetic oligonucleotide
  source 1..25: mol_type = other DNA
atgccagcatttcctgcaaatgaga

SEQ ID NO: 1050 - DNA, 25 bp, synthetic construct
  misc_feature 1..25: note = Description of Artificial Sequence: Synthetic oligonucleotide
  source 1..25: mol_type = other DNA
atgccagcatttcctgcaaatgaga

SEQ ID NO: 1051 - DNA, 25 bp, synthetic construct
  misc_feature 1..25: note = Description of Artificial Sequence: Synthetic oligonucleotide
  source 1..25: mol_type = other DNA
atgccagcatttcctgcaaatgaga

SEQ ID NO: 1052 - DNA, 25 bp, synthetic construct
  misc_feature 1..25: note = Description of Artificial Sequence: Synthetic oligonucleotide
  source 1..25: mol_type = other DNA
atgccagcatttcctgcaaatgaga

SEQ ID NO: 1053 - DNA, 25 bp, synthetic construct
  misc_feature 1..25: note = Description of Artificial Sequence: Synthetic oligonucleotide
  source 1..25: mol_type = other DNA
atgccagcatttcctgcaaatgaga

SEQ ID NO: 1054 - DNA, 25 bp, synthetic construct
  misc_feature 1..25: note = Description of Artificial Sequence: Synthetic oligonucleotide
  source 1..25: mol_type = other DNA
atgccagcatttcctgcaaatgaga

SEQ ID NO: 1055 - DNA, 25 bp, synthetic construct
  misc_feature 1..25: note = Description of Artificial Sequence: Synthetic oligonucleotide
  source 1..25: mol_type = other DNA
atgccagcatttcctgcaaatgaga

SEQ ID NO: 1056 - DNA, 25 bp, synthetic construct
  misc_feature 1..25: note = Description of Artificial Sequence: Synthetic oligonucleotide
  source 1..25: mol_type = other DNA
gctctatgccagcatttcctgcaaa

SEQ ID NO: 1057 - DNA, 25 bp, synthetic construct
  misc_feature 1..25: note = Description of Artificial Sequence: Synthetic oligonucleotide
  source 1..25: mol_type = other DNA
gctctatgccagcatttcctgcaaa

SEQ ID NO: 1058 - DNA, 25 bp, synthetic construct
  misc_feature 1..25: note = Description of Artificial Sequence: Synthetic oligonucleotide
  source 1..25: mol_type = other DNA
gctctatgccagcatttcctgcaaa

SEQ ID NO: 1059 - DNA, 25 bp, synthetic construct
  misc_feature 1..25: note = Description of Artificial Sequence: Synthetic oligonucleotide
  source 1..25: mol_type = other DNA
gctctatgccagcatttcctgcaaa

SEQ ID NO: 1060 - DNA, 25 bp, synthetic construct
  misc_feature 1..25: note = Description of Artificial Sequence: Synthetic oligonucleotide
  source 1..25: mol_type = other DNA
gctctatgccagcatttcctgcaaa

SEQ ID NO: 1061 - DNA, 25 bp, synthetic construct
  misc_feature 1..25: note = Description of Artificial Sequence: Synthetic oligonucleotide
  source 1..25: mol_type = other DNA
gctctatgccagcatttcctgcaaa

SEQ ID NO: 1062 - DNA, 25 bp, synthetic construct
  misc_feature 1..25: note = Description of Artificial Sequence: Synthetic oligonucleotide
  source 1..25: mol_type = other DNA
gctctatgccagcatttcctgcaaa

SEQ ID NO: 1063 - DNA, 25 bp, synthetic construct
  misc_feature 1..25: note = Description of Artificial Sequence: Synthetic oligonucleotide
  source 1..25: mol_type = other DNA
gctctatgccagcatttcctgcaaa

SEQ ID NO: 1064 - DNA, 25 bp, synthetic construct
  misc_feature 1..25: note = Description of Artificial Sequence: Synthetic oligonucleotide
  source 1..25: mol_type = other DNA
gctctatgccagcatttcctgcaaa

SEQ ID NO: 1065 - DNA, 25 bp, synthetic construct
  misc_feature 1..25: note = Description of Artificial Sequence: Synthetic oligonucleotide
  source 1..25: mol_type = other DNA
gctctatgccagcatttcctgcaaa

SEQ ID NO: 1066 - DNA, 21 bp, synthetic construct
  misc_feature 1..21: note = Description of Artificial Sequence: Synthetic oligonucleotide
  source 1..21: mol_type = other DNA
gtgatggtgggtgaccttgag

SEQ ID NO: 1067 - DNA, 19 bp, synthetic construct
  misc_feature 1..19: note = Description of Artificial Sequence: Synthetic oligonucleotide
  source 1..19: mol_type = other DNA
tttgggcagcggtaatgag

SEQ ID NO: 1068 - DNA, 17 bp, synthetic construct
  misc_feature 1..17: note = Description of Artificial Sequence: Synthetic oligonucleotide
  source 1..17: mol_type = other DNA
caagcagaaggcaacaa

SEQ ID NO: 1069 - DNA, 26 bp, synthetic construct
  misc_feature 1..26: note = Description of Artificial Sequence: Synthetic oligonucleotide
  source 1..26: mol_type = other DNA
tgaaaataagctcaagcagacaaatc

SEQ ID NO: 1070 - DNA, 20 bp, synthetic construct
  misc_feature 1..20: note = Description of Artificial Sequence: Synthetic oligonucleotide
  source 1..20: mol_type = other DNA
gacgcctctgttccaaatcc

SEQ ID NO: 1071 - DNA, 18 bp, synthetic construct
  misc_feature 1..18: note = Description of Artificial Sequence: Synthetic oligonucleotide
  source 1..18: mol_type = other DNA
cagtggataaaggcaaca

SEQ ID NO: 1072 - DNA, 12 bp, synthetic construct
  misc_feature 1..12: note = Description of Artificial Sequence: Synthetic oligonucleotide
  source 1..12: mol_type = other DNA
cagtctgcttcg

SEQ ID NO: 1073 - DNA, 20 bp, synthetic construct
  misc_feature 1..20: note = Description of Artificial Sequence: Synthetic oligonucleotide
  source 1..20: mol_type = other DNA
gcctcagtctgcttcgcacc

SEQ ID NO: 1074 - DNA, 21 bp, synthetic construct
  misc_feature 1..21: note = Synthetic oligonucleotide
  modified_base 1..2: mod_base = OTHER; note = uracil
  modified_base 4: mod_base = OTHER; note = uracil
  modified_base 10: mod_base = OTHER; note = uracil
  modified_base 12..15: mod_base = OTHER; note = uracil
  modified_base 18..19: mod_base = OTHER; note = uracil
  source 1..21: mol_type = other DNA
ttctagacctgttttgctttt

SEQ ID NO: 1075 - DNA, 21 bp, synthetic construct
  misc_feature 1..21: note = Synthetic oligonucleotide
  modified_base 1..2: mod_base = OTHER; note = uracil
  modified_base 4: mod_base = OTHER; note = uracil
  modified_base 10: mod_base = OTHER; note = uracil
  modified_base 12..15: mod_base = OTHER; note = uracil
  modified_base 18..19: mod_base = OTHER; note = uracil
  source 1..21: mol_type = other DNA
ttctagacctgttttgctttt

SEQ ID NO: 1076 - DNA, 21 bp, synthetic construct
  misc_feature 1..21: note = Synthetic oligonucleotide
  modified_base 13: mod_base = OTHER; note = uracil
  modified_base 15: mod_base = OTHER; note = uracil
  source 1..21: mol_type = other DNA
aagcaaaacaggtctagaatt

SEQ ID NO: 1077 - DNA, 21 bp, synthetic construct
  misc_feature 1..21: note = Synthetic oligonucleotide
  modified_base 13: mod_base = OTHER; note = uracil
  modified_base 15: mod_base = OTHER; note = uracil
  source 1..21: mol_type = other DNA
aagcaaaacaggtctagaatt

SEQ ID NO: 1078 - DNA, 21 bp, synthetic construct
  misc_feature 1..21: note = Synthetic oligonucleotide
  modified_base 13: mod_base = OTHER; note = uracil
  modified_base 15: mod_base = OTHER; note = uracil
  source 1..21: mol_type = other DNA
aagcaaaacaggtctagaatt

SEQ ID NO: 1079 - DNA, 20 bp, synthetic construct
  misc_feature 1..20: note = Synthetic oligonucleotide
  modified_base 12: mod_base = OTHER; note = uracil
  modified_base 14: mod_base = OTHER; note = uracil
  source 1..20: mol_type = other DNA
agcaaaacaggtctagaatt

SEQ ID NO: 1080 - DNA, 20 bp, synthetic construct
  misc_feature 1..20: note = Synthetic oligonucleotide
  modified_base 12: mod_base = OTHER; note = uracil
  modified_base 14: mod_base = OTHER; note = uracil
  source 1..20: mol_type = other DNA
agcaaaacaggtctagaatt

SEQ ID NO: 1081 - DNA, 20 bp, synthetic construct
  misc_feature 1..20: note = Synthetic oligonucleotide
  modified_base 12: mod_base = OTHER; note = uracil
  modified_base 14: mod_base = OTHER; note = uracil
  source 1..20: mol_type = other DNA
agcaaaacaggtctagaatt

SEQ ID NO: 1082 - DNA, 21 bp, synthetic construct
  misc_feature 1..21: note = Synthetic oligonucleotide
  modified_base 1..2: mod_base = OTHER; note = uracil
  modified_base 4: mod_base = OTHER; note = uracil
  modified_base 10: mod_base = OTHER; note = uracil
  modified_base 12..15: mod_base = OTHER; note = uracil
  modified_base 18..19: mod_base = OTHER; note = uracil
  source 1..21: mol_type = other DNA
ttctagacctgttttgctttt

SEQ ID NO: 1083 - DNA, 21 bp, synthetic construct
  misc_feature 1..21: note = Synthetic oligonucleotide
  modified_base 1..2: mod_base = OTHER; note = uracil
  modified_base 4: mod_base = OTHER; note = uracil
  modified_base 10: mod_base = OTHER; note = uracil
  modified_base 12..15: mod_base = OTHER; note = uracil
  modified_base 18..19: mod_base = OTHER; note = uracil
  source 1..21: mol_type = other DNA
ttctagacctgttttgctttt

SEQ ID NO: 1084 - DNA, 21 bp, synthetic construct
  misc_feature 1..21: note = Synthetic oligonucleotide
  modified_base 1..2: mod_base = OTHER; note = uracil
  modified_base 4: mod_base = OTHER; note = uracil
  modified_base 10: mod_base = OTHER; note = uracil
  modified_base 12..15: mod_base = OTHER; note = uracil
  modified_base 18..19: mod_base = OTHER; note = uracil
  source 1..21: mol_type = other DNA
ttctagacctgttttgctttt

SEQ ID NO: 1085 - DNA, 21 bp, synthetic construct
  misc_feature 1..21: note = Synthetic oligonucleotide
  modified_base 1..2: mod_base = OTHER; note = uracil
  modified_base 4: mod_base = OTHER; note = uracil
  modified_base 10: mod_base = OTHER; note = uracil
  modified_base 12..15: mod_base = OTHER; note = uracil
  modified_base 18..19: mod_base = OTHER; note = uracil
  source 1..21: mol_type = other DNA
ttctagacctgttttgctttt

SEQ ID NO: 1086 - DNA, 21 bp, synthetic construct
  misc_feature 1..21: note = Synthetic oligonucleotide
  modified_base 1..2: mod_base = OTHER; note = uracil
  modified_base 4: mod_base = OTHER; note = uracil
  modified_base 10: mod_base = OTHER; note = uracil
  modified_base 12..15: mod_base = OTHER; note = uracil
  modified_base 18..19: mod_base = OTHER; note = uracil
  source 1..21: mol_type = other DNA
ttctagacctgttttgctttt

SEQ ID NO: 1087 - DNA, 21 bp, synthetic construct
  misc_feature 1..21: note = Synthetic oligonucleotide
  modified_base 1..2: mod_base = OTHER; note = uracil
  modified_base 4: mod_base = OTHER; note = uracil
  modified_base 10: mod_base = OTHER; note = uracil
  modified_base 12..15: mod_base = OTHER; note = uracil
  modified_base 18..19: mod_base = OTHER; note = uracil
  source 1..21: mol_type = other DNA
ttctagacctgttttgctttt

SEQ ID NO: 1088 - DNA, 21 bp, synthetic construct
  misc_feature 1..21: note = Synthetic oligonucleotide
  modified_base 13: mod_base = OTHER; note = uracil
  modified_base 15: mod_base = OTHER; note = uracil
  source 1..21: mol_type = other DNA
aagcaaaacaggtctagaatt

SEQ ID NO: 1089 - DNA, 21 bp, synthetic construct
  misc_feature 1..21: note = Synthetic oligonucleotide
  modified_base 13: mod_base = OTHER; note = uracil
  modified_base 15: mod_base = OTHER; note = uracil
  source 1..21: mol_type = other DNA
aagcaaaacaggtctagaatt

SEQ ID NO: 1090 - DNA, 21 bp, synthetic construct
  misc_feature 1..21: note = Synthetic oligonucleotide
  modified_base 13: mod_base = OTHER; note = uracil
  modified_base 15: mod_base = OTHER; note = uracil
  source 1..21: mol_type = other DNA
aagcaaaacaggtctagaatt

SEQ ID NO: 1091 - DNA, 21 bp, synthetic construct
  misc_feature 1..21: note = Synthetic oligonucleotide
  modified_base 13: mod_base = OTHER; note = uracil
  modified_base 15: mod_base = OTHER; note = uracil
  source 1..21: mol_type = other DNA
aagcaaaacaggtctagaatt

SEQ ID NO: 1092 - DNA, 21 bp, synthetic construct
  misc_feature 1..21: note = Synthetic oligonucleotide
  modified_base 13: mod_base = OTHER; note = uracil
  modified_base 15: mod_base = OTHER; note = uracil
  source 1..21: mol_type = other DNA
aagcaaaacaggtctagaatt

SEQ ID NO: 1093 - DNA, 21 bp, synthetic construct
  misc_feature 1..21: note = Synthetic oligonucleotide
  modified_base 13: mod_base = OTHER; note = uracil
  modified_base 15: mod_base = OTHER; note = uracil
  source 1..21: mol_type = other DNA
aagcaaaacaggtctagaatt

SEQ ID NO: 1094 - DNA, 21 bp, synthetic construct
  misc_feature 1..21: note = Synthetic oligonucleotide
  modified_base 13: mod_base = OTHER; note = uracil
  modified_base 15: mod_base = OTHER; note = uracil
  source 1..21: mol_type = other DNA
aagcaaaacaggtctagaatt

SEQ ID NO: 1095 - DNA, 21 bp, synthetic construct
  misc_feature 1..21: note = Synthetic oligonucleotide
  modified_base 13: mod_base = OTHER; note = uracil
  modified_base 15: mod_base = OTHER; note = uracil
  source 1..21: mol_type = other DNA
aagcaaaacaggtctagaatt

SEQ ID NO: 1096 - DNA, 21 bp, synthetic construct
  misc_feature 1..21: note = Synthetic oligonucleotide
  modified_base 13: mod_base = OTHER; note = uracil
  modified_base 15: mod_base = OTHER; note = uracil
  source 1..21: mol_type = other DNA
aagcaaaacaggtctagaatt

SEQ ID NO: 1097 - DNA, 21 bp, synthetic construct
  misc_feature 1..21: note = Synthetic oligonucleotide
  modified_base 13: mod_base = OTHER; note = uracil
  modified_base 15: mod_base = OTHER; note = uracil
  source 1..21: mol_type = other DNA
aagcaaaacaggtctagaatt

SEQ ID NO: 1098 - DNA, 21 bp, synthetic construct
  misc_feature 1..21: note = Synthetic oligonucleotide
  modified_base 13: mod_base = OTHER; note = uracil
  modified_base 15: mod_base = OTHER; note = uracil
  source 1..21: mol_type = other DNA
aagcaaaacaggtctagaatt

SEQ ID NO: 1099 - DNA, 21 bp, synthetic construct
  misc_feature 1..21: note = Synthetic oligonucleotide
  modified_base 13: mod_base = OTHER; note = uracil
  modified_base 15: mod_base = OTHER; note = uracil
  source 1..21: mol_type = other DNA
aagcaaaacaggtctagaatt

SEQ ID NO: 1100 - DNA, 21 bp, synthetic construct
  misc_feature 1..21: note = Synthetic oligonucleotide
  modified_base 1..2: mod_base = OTHER; note = uracil
  modified_base 4: mod_base = OTHER; note = uracil
  modified_base 10: mod_base = OTHER; note = uracil
  modified_base 12..15: mod_base = OTHER; note = uracil
  modified_base 18..19: mod_base = OTHER; note = uracil
  source 1..21: mol_type = other DNA
ttctagacctgttttgctttt

SEQ ID NO: 1101 - DNA, 21 bp, synthetic construct
  misc_feature 1..21: note = Synthetic oligonucleotide
  modified_base 1..2: mod_base = OTHER; note = uracil
  modified_base 4: mod_base = OTHER; note = uracil
  modified_base 10: mod_base = OTHER; note = uracil
  modified_base 12..15: mod_base = OTHER; note = uracil
  modified_base 18..19: mod_base = OTHER; note = uracil
  source 1..21: mol_type = other DNA
ttctagacctgttttgctttt

SEQ ID NO: 1102 - DNA, 21 bp, synthetic construct
  misc_feature 1..21: note = Synthetic oligonucleotide
  modified_base 1..2: mod_base = OTHER; note = uracil
  modified_base 4: mod_base = OTHER; note = uracil
  modified_base 10: mod_base = OTHER; note = uracil
  modified_base 12..15: mod_base = OTHER; note = uracil
  modified_base 18..19: mod_base = OTHER; note = uracil
  source 1..21: mol_type = other DNA
ttctagacctgttttgctttt

SEQ ID NO: 1103 - DNA, 21 bp, synthetic construct
  misc_feature 1..21: note = Synthetic oligonucleotide
  modified_base 1..2: mod_base = OTHER; note = uracil
  modified_base 4: mod_base = OTHER; note = uracil
  modified_base 10: mod_base = OTHER; note = uracil
  modified_base 12..15: mod_base = OTHER; note = uracil
  modified_base 18..19: mod_base = OTHER; note = uracil
  source 1..21: mol_type = other DNA
ttctagacctgttttgctttt

SEQ ID NO: 1104 - DNA, 21 bp, synthetic construct
  misc_feature 1..21: note = Synthetic oligonucleotide
  modified_base 1..2: mod_base = OTHER; note = uracil
  modified_base 4: mod_base = OTHER; note = uracil
  modified_base 10: mod_base = OTHER; note = uracil
  modified_base 12..15: mod_base = OTHER; note = uracil
  modified_base 18..19: mod_base = OTHER; note = uracil
  source 1..21: mol_type = other DNA
ttctagacctgttttgctttt

SEQ ID NO: 1105 - DNA, 21 bp, synthetic construct
  misc_feature 1..21: note = Synthetic oligonucleotide
  modified_base 1..2: mod_base = OTHER; note = uracil
  modified_base 4: mod_base = OTHER; note = uracil
  modified_base 10: mod_base = OTHER; note = uracil
  modified_base 12..15: mod_base = OTHER; note = uracil
  modified_base 18..19: mod_base = OTHER; note = uracil
  source 1..21: mol_type = other DNA
ttctagacctgttttgctttt

SEQ ID NO: 1106 - DNA, 21 bp, synthetic construct
  misc_feature 1..21: note = Synthetic oligonucleotide
  modified_base 13: mod_base = OTHER; note = uracil
  modified_base 15: mod_base = OTHER; note = uracil
  source 1..21: mol_type = other DNA
aagcaaaacaggtctagaatt

SEQ ID NO: 1107 - DNA, 21 bp, synthetic construct
  misc_feature 1..21: note = Synthetic oligonucleotide
  modified_base 13: mod_base = OTHER; note = uracil
  modified_base 15: mod_base = OTHER; note = uracil
  source 1..21: mol_type = other DNA
aagcaaaacaggtctagaatt

SEQ ID NO: 1108 - DNA, 21 bp, synthetic construct
  misc_feature 1..21: note = Synthetic oligonucleotide
  modified_base 13: mod_base = OTHER; note = uracil
  modified_base 15: mod_base = OTHER; note = uracil
  source 1..21: mol_type = other DNA
aagcaaaacaggtctagaatt

SEQ ID NO: 1109 - DNA, 21 bp, synthetic construct
  misc_feature 1..21: note = Synthetic oligonucleotide
  modified_base 13: mod_base = OTHER; note = uracil
  modified_base 15: mod_base = OTHER; note = uracil
  source 1..21: mol_type = other DNA
aagcaaaacaggtctagaatt

SEQ ID NO: 1110 - DNA, 21 bp, synthetic construct
  misc_feature 1..21: note = Synthetic oligonucleotide
  modified_base 13: mod_base = OTHER; note = uracil
  modified_base 15: mod_base = OTHER; note = uracil
  source 1..21: mol_type = other DNA
aagcaaaacaggtctagaatt

SEQ ID NO: 1111 - DNA, 21 bp, synthetic construct
  misc_feature 1..21: note = Synthetic oligonucleotide
  modified_base 13: mod_base = OTHER; note = uracil
  modified_base 15: mod_base = OTHER; note = uracil
  source 1..21: mol_type = other DNA
aagcaaaacaggtctagaatt

SEQ ID NO: 1112 - DNA, 21 bp, synthetic construct
  misc_feature 1..21: note = Synthetic oligonucleotide
  modified_base 13: mod_base = OTHER; note = uracil
  modified_base 15: mod_base = OTHER; note = uracil
  source 1..21: mol_type = other DNA
aagcaaaacaggtctagaatt

SEQ ID NO: 1113 - DNA, 21 bp, synthetic construct
  misc_feature 1..21: note = Synthetic oligonucleotide
  modified_base 13: mod_base = OTHER; note = uracil
  modified_base 15: mod_base = OTHER; note = uracil
  source 1..21: mol_type = other DNA
aagcaaaacaggtctagaatt

SEQ ID NO: 1114 - DNA, 10 bp, synthetic construct
  misc_feature 1..10: note = Description of Artificial Sequence: Synthetic oligonucleotide
  source 1..10: mol_type = other DNA
acacacacac

SEQ ID NO: 1115 - DNA, 10 bp, synthetic construct
  misc_feature 1..10: note = Description of Artificial Sequence: Synthetic oligonucleotide
  source 1..10: mol_type = other DNA
cccccccccc

SEQ ID NO: 1116 - DNA, 10 bp, synthetic construct
  misc_feature 1..10: note = Description of Artificial Sequence: Synthetic oligonucleotide
  source 1..10: mol_type = other DNA
cccccccccc

SEQ ID NO: 1117 - DNA, 10 bp, synthetic construct
  misc_feature 1..10: note = Description of Artificial Sequence: Synthetic oligonucleotide
  source 1..10: mol_type = other DNA
cccccccccc

SEQ ID NO: 1118 - DNA, 12 bp, synthetic construct
  misc_feature 1..12: note = Description of Artificial Sequence: Synthetic oligonucleotide
  source 1..12: mol_type = other DNA
ggatgttctcga

SEQ ID NO: 1119 - DNA, 12 bp, synthetic construct
  misc_feature 1..12: note = Description of Artificial Sequence: Synthetic oligonucleotide
  source 1..12: mol_type = other DNA
ggatgttctcga

SEQ ID NO: 1120 - DNA, 12 bp, synthetic construct
  misc_feature 1..12: note = Description of Artificial Sequence: Synthetic oligonucleotide
  source 1..12: mol_type = other DNA
ggatgttctcga

SEQ ID NO: 1121 - DNA, 60 bp, Mus musculus
  source 1..60: mol_type = genomic DNA
gtggttactaaggaaactgtcatctccaaactagaaatgccatcttctttgctgttggag

SEQ ID NO: 1122 - DNA, 60 bp, Homo sapiens
  source 1..60: mol_type = genomic DNA
gtggttactaaggaaactgccatctccaaactagaaatgccatcttccttgatgttggag

SEQ ID NO: 1123 - RNA, 19 nt, synthetic construct
  misc_feature 1..19: note = Description of Artificial Sequence: Synthetic oligonucleotide
  source 1..19: mol_type = other RNA
tcaaggaagatggcatttc

SEQ ID NO: 1124 - RNA, 18 nt, synthetic construct
  misc_feature 1..18: note = Description of Artificial Sequence: Synthetic oligonucleotide
  source 1..18: mol_type = other RNA
tcaaggaagatggcattt

SEQ ID NO: 1125 - RNA, 19 nt, synthetic construct
  misc_feature 1..19: note = Description of Artificial Sequence: Synthetic oligonucleotide
  source 1..19: mol_type = other RNA
caaggaagatggcatttct

SEQ ID NO: 1126 - RNA, 20 nt, synthetic construct
  misc_feature 1..20: note = Description of Artificial Sequence: Synthetic oligonucleotide
  source 1..20: mol_type = other RNA
ggccaaacctcggcttacct

SEQ ID NO: 1127 - RNA, 20 nt, synthetic construct
  misc_feature 1..20: note = Description of Artificial Sequence: Synthetic oligonucleotide
  source 1..20: mol_type = other RNA
ttctgtaaggtttttatgtg

SEQ ID NO: 1128 - RNA, 20 nt, synthetic construct
  misc_feature 1..20: note = Description of Artificial Sequence: Synthetic oligonucleotide
  source 1..20: mol_type = other RNA
atttctgtaaggtttttatg

SEQ ID NO: 1129 - RNA, 20 nt, synthetic construct
  misc_feature 1..20: note = Description of Artificial Sequence: Synthetic oligonucleotide
  source 1..20: mol_type = other RNA
ccatttctgtaaggttttta

SEQ ID NO: 1130 - RNA, 20 nt, synthetic construct
  misc_feature 1..20: note = Description of Artificial Sequence: Synthetic oligonucleotide
  source 1..20: mol_type = other RNA
atccatttctgtaaggtttt

SEQ ID NO: 1131 - RNA, 20 nt, synthetic construct
  misc_feature 1..20: note = Description of Artificial Sequence: Synthetic oligonucleotide
  source 1..20: mol_type = other RNA
catccatttctgtaaggttt

SEQ ID NO: 1132 - RNA, 20 nt, synthetic construct
  misc_feature 1..20: note = Description of Artificial Sequence: Synthetic oligonucleotide
  source 1..20: mol_type = other RNA
ccatccatttctgtaaggtt

SEQ ID NO: 1133 - RNA, 20 nt, synthetic construct
  misc_feature 1..20: note = Description of Artificial Sequence: Synthetic oligonucleotide
  source 1..20: mol_type = other RNA
gccatccatttctgtaaggt

SEQ ID NO: 1134 - RNA, 20 nt, synthetic construct
  misc_feature 1..20: note = Description of Artificial Sequence: Synthetic oligonucleotide
  source 1..20: mol_type = other RNA
agccatccatttctgtaagg

SEQ ID NO: 1135 - RNA, 20 nt, synthetic construct
  misc_feature 1..20: note = Description of Artificial Sequence: Synthetic oligonucleotide
  source 1..20: mol_type = other RNA
cagccatccatttctgtaag

SEQ ID NO: 1136 - RNA, 20 nt, synthetic construct
  misc_feature 1..20: note = Description of Artificial Sequence: Synthetic oligonucleotide
  source 1..20: mol_type = other RNA
tcagccatccatttctgtaa

SEQ ID NO: 1137 - RNA, 20 nt, synthetic construct
  misc_feature 1..20: note = Description of Artificial Sequence: Synthetic oligonucleotide
  source 1..20: mol_type = other RNA
ttcagccatccatttctgta

SEQ ID NO: 1138 - RNA, 20 nt, synthetic construct
  misc_feature 1..20: note = Description of Artificial Sequence: Synthetic oligonucleotide
  source 1..20: mol_type = other RNA
cttcagccatccatttctgt

SEQ ID NO: 1139 - RNA, 20 nt, synthetic construct
  misc_feature 1..20: note = Description of Artificial Sequence: Synthetic oligonucleotide
  source 1..20: mol_type = other RNA
acttcagccatccatttctg

SEQ ID NO: 1140 - RNA, 20 nt, synthetic construct
  misc_feature 1..20: note = Description of Artificial Sequence: Synthetic oligonucleotide
  source 1..20: mol_type = other RNA
aacttcagccatccatttct

SEQ ID NO: 1141 - RNA, 20 nt, synthetic construct
  misc_feature 1..20: note = Description of Artificial Sequence: Synthetic oligonucleotide
  source 1..20: mol_type = other RNA
caacttcagccatccatttc

SEQ ID NO: 1142 - RNA, 20 nt, synthetic construct
  misc_feature 1..20: note = Description of Artificial Sequence: Synthetic oligonucleotide
  source 1..20: mol_type = other RNA
tcaacttcagccatccattt

SEQ ID NO: 1143 - RNA, 20 nt, synthetic construct
  misc_feature 1..20: note = Description of Artificial Sequence: Synthetic oligonucleotide
  source 1..20: mol_type = other RNA
atcaacttcagccatccatt

SEQ ID NO: 1144 - RNA, 20 nt, synthetic construct
  misc_feature 1..20: note = Description of Artificial Sequence: Synthetic oligonucleotide
  source 1..20: mol_type = other RNA
catcaacttcagccatccat

SEQ ID NO: 1145 - RNA, 20 nt, synthetic construct
  misc_feature 1..20: note = Description of Artificial Sequence: Synthetic oligonucleotide
  source 1..20: mol_type = other RNA
acatcaacttcagccatcca

SEQ ID NO: 1146 - RNA, 20 nt, synthetic construct
  misc_feature 1..20: note = Description of Artificial Sequence: Synthetic oligonucleotide
  source 1..20: mol_type = other RNA
aacatcaacttcagccatcc

SEQ ID NO: 1147 - RNA, 20 nt, synthetic construct
  misc_feature 1..20: note = Description of Artificial Sequence: Synthetic oligonucleotide
  source 1..20: mol_type = other RNA
gaaaacatcaacttcagcca

SEQ ID NO: 1148 - RNA, 20 nt, synthetic construct
  misc_feature 1..20: note = Description of Artificial Sequence: Synthetic oligonucleotide
  source 1..20: mol_type = other RNA
caggaaaacatcaacttcag

SEQ ID NO: 1149 - RNA, 20 nt, synthetic construct
  misc_feature 1..20: note = Description of Artificial Sequence: Synthetic oligonucleotide
  source 1..20: mol_type = other RNA
tttcaggaaaacatcaactt

SEQ ID NO: 1150 - RNA, 20 nt, synthetic construct
  misc_feature 1..20: note = Description of Artificial Sequence: Synthetic oligonucleotide
  source 1..20: mol_type = other RNA
ctctttcaggaaaacatcaa

SEQ ID NO: 1151 - RNA, 20 nt, synthetic construct
  misc_feature 1..20: note = Description of Artificial Sequence: Synthetic oligonucleotide
  source 1..20: mol_type = other RNA
ttcctctttcaggaaaacat

SEQ ID NO: 1152 - RNA, 20 nt, synthetic construct
  misc_feature 1..20: note = Description of Artificial Sequence: Synthetic oligonucleotide
  source 1..20: mol_type = other RNA
gccattcctctttcaggaaa

SEQ ID NO: 1153 - RNA, 20 nt, synthetic construct
  misc_feature 1..20: note = Description of Artificial Sequence: Synthetic oligonucleotide
  source 1..20: mol_type = other RNA
ggccattcctctttcaggaa

SEQ ID NO: 1154 - RNA, 20 nt, synthetic construct
  misc_feature 1..20: note = Description of Artificial Sequence: Synthetic oligonucleotide
  source 1..20: mol_type = other RNA
aggccattcctctttcagga

SEQ ID NO: 1155 - RNA, 20 nt, synthetic construct
  misc_feature 1..20: note = Description of Artificial Sequence: Synthetic oligonucleotide
  source 1..20: mol_type = other RNA
caggccattcctctttcagg

SEQ ID NO: 1156 - RNA, 20 nt, synthetic construct
  misc_feature 1..20: note = Description of Artificial Sequence: Synthetic oligonucleotide
  source 1..20: mol_type = other RNA
gcaggccattcctctttcag

SEQ ID NO: 1157 - RNA, 20 nt, synthetic construct
  misc_feature 1..20: note = Description of Artificial Sequence: Synthetic oligonucleotide
  source 1..20: mol_type = other RNA
ggcaggccattcctctttca

SEQ ID NO: 1158 - RNA, 20 nt, synthetic construct
  misc_feature 1..20: note = Description of Artificial Sequence: Synthetic oligonucleotide
  source 1..20: mol_type = other RNA
gggcaggccattcctctttc

SEQ ID NO: 1159 - RNA, 20 nt, synthetic construct
  misc_feature 1..20: note = Description of Artificial Sequence: Synthetic oligonucleotide
  source 1..20: mol_type = other RNA
agggcaggccattcctcttt

SEQ ID NO: 1160 - RNA, 20 nt, synthetic construct
  misc_feature 1..20: note = Description of Artificial Sequence: Synthetic oligonucleotide
  source 1..20: mol_type = other RNA
cagggcaggccattcctctt

SEQ ID NO: 1161 - RNA, 20 nt, synthetic construct
  misc_feature 1..20: note = Description of Artificial Sequence: Synthetic oligonucleotide
  source 1..20: mol_type = other RNA
ccagggcaggccattcctct

SEQ ID NO: 1162 - RNA, 20 nt, synthetic construct
  misc_feature 1..20: note = Description of Artificial Sequence: Synthetic oligonucleotide
  source 1..20: mol_type = other RNA
cccagggcaggccattcctc

SEQ ID NO: 1163 - RNA, 20 nt, synthetic construct
  misc_feature 1..20: note = Description of Artificial Sequence: Synthetic oligonucleotide
  source 1..20: mol_type = other RNA
ccccagggcaggccattcct

SEQ ID NO: 1164 - RNA, 20 nt, synthetic construct
  misc_feature 1..20: note = Description of Artificial Sequence: Synthetic oligonucleotide
  source 1..20: mol_type = other RNA
cccccagggcaggccattcc

SEQ ID NO: 1165 - RNA, 20 nt, synthetic construct
  misc_feature 1..20: note = Description of Artificial Sequence: Synthetic oligonucleotide
  source 1..20: mol_type = other RNA
tcccccagggcaggccattc

SEQ ID NO: 1166 - RNA, 20 nt, synthetic construct
  misc_feature 1..20: note = Description of Artificial Sequence: Synthetic oligonucleotide
  source 1..20: mol_type = other RNA
atcccccagggcaggccatt

SEQ ID NO: 1167 - RNA, 20 nt, synthetic construct
  misc_feature 1..20: note = Description of Artificial Sequence: Synthetic oligonucleotide
  source 1..20: mol_type = other RNA
catcccccagggcaggccat

SEQ ID NO: 1168 - RNA, 20 nt, synthetic construct
  misc_feature 1..20: note = Description of Artificial Sequence: Synthetic oligonucleotide
  source 1..20: mol_type = other RNA
gcatcccccagggcaggcca

SEQ ID NO: 1169 - RNA, 20 nt, synthetic construct
  misc_feature 1..20: note = Description of Artificial Sequence: Synthetic oligonucleotide
  source 1..20: mol_type = other RNA
agcatcccccagggcaggcc

SEQ ID NO: 1170 - RNA, 20 nt, synthetic construct
  misc_feature 1..20: note = Description of Artificial Sequence: Synthetic oligonucleotide
  source 1..20: mol_type = other RNA
cagcatcccccagggcaggc

SEQ ID NO: 1171 - RNA, 20 nt, synthetic construct
  misc_feature 1..20: note = Description of Artificial Sequence: Synthetic oligonucleotide
  source 1..20: mol_type = other RNA
tcagcatcccccagggcagg

SEQ ID NO: 1172 - RNA, 20 nt, synthetic construct
  misc_feature 1..20: note = Description of Artificial Sequence: Synthetic oligonucleotide
  source 1..20: mol_type = other RNA
ttcagcatcccccagggcag

SEQ ID NO: 1173 - RNA, 20 nt, synthetic construct
  misc_feature 1..20: note = Description of Artificial Sequence: Synthetic oligonucleotide
  source 1..20: mol_type = other RNA
tttcagcatcccccagggca

SEQ ID NO: 1174 - RNA, 20 nt, synthetic construct
  misc_feature 1..20: note = Description of Artificial Sequence: Synthetic oligonucleotide
  source 1..20: mol_type = other RNA
atttcagcatcccccagggc

SEQ ID NO: 1175 - RNA, 20 nt, synthetic construct
  misc_feature 1..20: note = Description of Artificial Sequence: Synthetic oligonucleotide
  source 1..20: mol_type = other RNA
gatttcagcatcccccaggg

SEQ ID NO: 1176 - RNA, 20 nt, synthetic construct
  misc_feature 1..20: note = Description of Artificial Sequence: Synthetic oligonucleotide
  source 1..20: mol_type = other RNA
ggatttcagcatcccccagg

SEQ ID NO: 1177 - RNA, 20 nt, synthetic construct
  misc_feature 1..20: note = Description of Artificial Sequence: Synthetic oligonucleotide
  source 1..20: mol_type = other RNA
aggatttcagcatcccccag

SEQ ID NO: 1178 - RNA, 20 nt, synthetic construct
  misc_feature 1..20: note = Description of Artificial Sequence: Synthetic oligonucleotide
  source 1..20: mol_type = other RNA
caggatttcagcatccccca

SEQ ID NO: 1179 - RNA, 20 nt, synthetic construct
  misc_feature 1..20: note = Description of Artificial Sequence: Synthetic oligonucleotide
  source 1..20: mol_type = other RNA
tcaggatttcagcatccccc

SEQ ID NO: 1180 - RNA, 20 nt, synthetic construct
  misc_feature 1..20: note = Description of Artificial Sequence: Synthetic oligonucleotide
  source 1..20: mol_type = other RNA
ttcaggatttcagcatcccc

SEQ ID NO: 1181 - RNA, 20 nt, synthetic construct
  misc_feature 1..20: note = Description of Artificial Sequence: Synthetic oligonucleotide
  source 1..20: mol_type = other RNA
tttcaggatttcagcatccc

SEQ ID NO: 1182 - RNA, 20 nt, synthetic construct
  misc_feature 1..20: note = Description of Artificial Sequence: Synthetic oligonucleotide
  source 1..20: mol_type = other RNA
ttttcaggatttcagcatcc

SEQ ID NO: 1183 - RNA, 20 nt, synthetic construct
  misc_feature 1..20: note = Description of Artificial Sequence: Synthetic oligonucleotide
  source 1..20: mol_type = other RNA
tttttcaggatttcagcatc

SEQ ID NO: 1184 - RNA, 20 nt, synthetic construct
  misc_feature 1..20: note = Description of Artificial Sequence: Synthetic oligonucleotide
  source 1..20: mol_type = other RNA
ttttttcaggatttcagcat

SEQ ID NO: 1185 - RNA, 20 nt, synthetic construct
  misc_feature 1..20: note = Description of Artificial Sequence: Synthetic oligonucleotide
  source 1..20: mol_type = other RNA
gttttttcaggatttcagca

SEQ ID NO: 1186 - RNA, 20 nt, synthetic construct
  misc_feature 1..20: note = Description of Artificial Sequence: Synthetic oligonucleotide
  source 1..20: mol_type = other RNA
tgttttttcaggatttcagc

SEQ ID NO: 1187 - RNA, 20 nt, synthetic construct
  misc_feature 1..20: note = Description of Artificial Sequence: Synthetic oligonucleotide
  source 1..20: mol_type = other RNA
ctgttttttcaggatttcag

SEQ ID NO: 1188 - RNA, 20 nt, synthetic construct
  misc_feature 1..20: note = Description of Artificial Sequence: Synthetic oligonucleotide
  source 1..20: mol_type = other RNA
gctgttttttcaggatttca

SEQ ID NO: 1189 - RNA, 20 nt, synthetic construct
  misc_feature 1..20: note = Description of Artificial Sequence: Synthetic oligonucleotide
  source 1..20: mol_type = other RNA
agctgttttttcaggatttc

SEQ ID NO: 1190 - RNA, 20 nt, synthetic construct
  misc_feature 1..20: note = Description of Artificial Sequence: Synthetic oligonucleotide
  source 1..20: mol_type = other RNA
gagctgttttttcaggattt

SEQ ID NO: 1191 - RNA, 20 nt, synthetic construct
  misc_feature 1..20: note = Description of Artificial Sequence: Synthetic oligonucleotide
  source 1..20: mol_type = other RNA
tgagctgttttttcaggatt

SEQ ID NO: 1192 - RNA, 20 nt, synthetic construct
  misc_feature 1..20: note = Description of Artificial Sequence: Synthetic oligonucleotide
  source 1..20: mol_type = other RNA
ttgagctgttttttcaggat

SEQ ID NO: 1193 - RNA, 20 nt, synthetic construct
  misc_feature 1..20: note = Description of Artificial Sequence: Synthetic oligonucleotide
  source 1..20: mol_type = other RNA
tttgagctgttttttcagga

SEQ ID NO: 1194 - RNA, 20 nt, synthetic construct
  misc_feature 1..20: note = Description of Artificial Sequence: Synthetic oligonucleotide
  source 1..20: mol_type = other RNA
gtttgagctgttttttcagg

SEQ ID NO: 1195 - RNA, 20 nt, synthetic construct
  misc_feature 1..20: note = Description of Artificial Sequence: Synthetic oligonucleotide
  source 1..20: mol_type = other RNA
ttgtttgagctgttttttca

SEQ ID NO: 1196 - RNA, 20 nt, synthetic construct
  misc_feature 1..20: note = Description of Artificial Sequence: Synthetic oligonucleotide
  source 1..20: mol_type = other RNA
cattgtttgagctgtttttt

SEQ ID NO: 1197 - RNA, 20 nt, synthetic construct
  misc_feature 1..20: note = Description of Artificial Sequence: Synthetic oligonucleotide
  source 1..20: mol_type = other RNA
gcattgtttgagctgttttt

SEQ ID NO: 1198 - RNA, 20 nt, synthetic construct
  misc_feature 1..20: note = Description of Artificial Sequence: Synthetic oligonucleotide
  source 1..20: mol_type = other RNA
tgcattgtttgagctgtttt

SEQ ID NO: 1199 - RNA, 20 nt, synthetic construct
  misc_feature 1..20: note = Description of Artificial Sequence: Synthetic oligonucleotide
  source 1..20: mol_type = other RNA
ctgcattgtttgagctgttt

SEQ ID NO: 1200 - RNA, 20 nt, synthetic construct
  misc_feature 1..20: note = Description of Artificial Sequence: Synthetic oligonucleotide
  source 1..20: mol_type = other RNA
tctgcattgtttgagctgtt

SEQ ID NO: 1201 - RNA, 20 nt, synthetic construct
  misc_feature 1..20: note = Description of Artificial Sequence: Synthetic oligonucleotide
  source 1..20: mol_type = other RNA
ctctgcattgtttgagctgt

SEQ ID NO: 1202 - RNA, 20 nt, synthetic construct
  misc_feature 1..20: note = Description of Artificial Sequence: Synthetic oligonucleotide
  source 1..20: mol_type = other RNA
actctgcattgtttgagctg

SEQ ID NO: 1203 - RNA, 20 nt, synthetic construct
  misc_feature 1..20: note = Description of Artificial Sequence: Synthetic oligonucleotide
  source 1..20: mol_type = other RNA
tactctgcattgtttgagct

SEQ ID NO: 1204 - RNA, 20 nt, synthetic construct
  misc_feature 1..20: note = Description of Artificial Sequence: Synthetic oligonucleotide
  source 1..20: mol_type = other RNA
ttactctgcattgtttgagc

SEQ ID NO: 1205 - RNA, 20 nt, synthetic construct
  misc_feature 1..20: note = Description of Artificial Sequence: Synthetic oligonucleotide
  source 1..20: mol_type = other RNA
cttactctgcattgtttgag

SEQ ID NO: 1206 - RNA, 20 nt, synthetic construct
  misc_feature 1..20: note = Description of Artificial Sequence: Synthetic oligonucleotide
  source 1..20: mol_type = other RNA
tcttactctgcattgtttga

SEQ ID NO: 1207 - RNA, 20 nt, synthetic construct
  misc_feature 1..20: note = Description of Artificial Sequence: Synthetic oligonucleotide
  source 1..20: mol_type = other RNA
atcttactctgcattgtttg

SEQ ID NO: 1208 - RNA, 20 nt, synthetic construct
  misc_feature 1..20: note = Description of Artificial Sequence: Synthetic oligonucleotide
  source 1..20: mol_type = other RNA
aatcttactctgcattgttt

SEQ ID NO: 1209 - RNA, 20 nt, synthetic construct
  misc_feature 1..20: note = Description of Artificial Sequence: Synthetic oligonucleotide
  source 1..20: mol_type = other RNA
caaatcttactctgcattgt

SEQ ID NO: 1210 - RNA, 20 nt, synthetic construct
  misc_feature 1..20: note = Description of Artificial Sequence: Synthetic oligonucleotide
  source 1..20: mol_type = other RNA
gatacaaatcttactctgca

SEQ ID NO: 1211 - DNA, 20 bp, synthetic construct
  misc_feature 1..20: note = Description of Artificial Sequence: Synthetic oligonucleotide
  source 1..20: mol_type = other DNA
gggtcagctgccaatgctag

SEQ ID NO: 1212 - RNA, 15 nt, synthetic construct
  misc_feature 1..15: note = Description of Artificial Sequence: Synthetic oligonucleotide
  source 1..15: mol_type = other RNA
tcaaggaagatggca

SEQ ID NO: 1213 - RNA, 15 nt, synthetic construct
  misc_feature 1..15: note = Description of Artificial Sequence: Synthetic oligonucleotide
  source 1..15: mol_type = other RNA
caaggaagatggcat

SEQ ID NO: 1214 - RNA, 15 nt, synthetic construct
  misc_feature 1..15: note = Description of Artificial Sequence: Synthetic oligonucleotide
  source 1..15: mol_type = other RNA
aaggaagatggcatt

SEQ ID NO: 1215 - RNA, 15 nt, synthetic construct
  misc_feature 1..15: note = Description of Artificial Sequence: Synthetic oligonucleotide
  source 1..15: mol_type = other RNA
aggaagatggcattt

SEQ ID NO: 1216 - RNA, 15 nt, synthetic construct
  misc_feature 1..15: note = Description of Artificial Sequence: Synthetic oligonucleotide
  source 1..15: mol_type = other RNA
ggaagatggcatttc

SEQ ID NO: 1217 - RNA, 15 nt, synthetic construct
  misc_feature 1..15: note = Description of Artificial Sequence: Synthetic oligonucleotide
  source 1..15: mol_type = other RNA
gaagatggcatttct

SEQ ID NO: 1218 - RNA, 18 nt, synthetic construct
  misc_feature 1..18: note = Description of Artificial Sequence: Synthetic oligonucleotide
  source 1..18: mol_type = other RNA
caaggaagatggcatttc

SEQ ID NO: 1219 - RNA, 18 nt, synthetic construct
  misc_feature 1..18: note = Description of Artificial Sequence: Synthetic oligonucleotide
  source 1..18: mol_type = other RNA
aaggaagatggcatttct

SEQ ID NO: 1220 - RNA, 16 nt, synthetic construct
  misc_feature 1..16: note = Description of Artificial Sequence: Synthetic oligonucleotide
  source 1..16: mol_type = other RNA
aaggaagatggcattt

SEQ ID NO: 1221 - RNA, 17 nt, synthetic construct
  misc_feature 1..17: note = Description of Artificial Sequence: Synthetic oligonucleotide
  source 1..17: mol_type = other RNA
caaggaagatggcattt

SEQ ID NO: 1222 - RNA, 17 nt, synthetic construct
  misc_feature 1..17: note = Description of Artificial Sequence: Synthetic oligonucleotide
  source 1..17: mol_type = other RNA
aaggaagatggcatttc

SEQ ID NO: 1223 - RNA, 14 nt, synthetic construct
  misc_feature 1..14: note = Description of Artificial Sequence: Synthetic oligonucleotide
  source 1..14: mol_type = other RNA
aggaagatggcatt

SEQ ID NO: 1224 - RNA, 14 nt, synthetic construct
  misc_feature 1..14: note = Description of Artificial Sequence: Synthetic oligonucleotide
  source 1..14: mol_type = other RNA
tcaaggaagatggc

SEQ ID NO: 1225 - RNA, 14 nt, synthetic construct
  misc_feature 1..14: note = Description of Artificial Sequence: Synthetic oligonucleotide
  source 1..14: mol_type = other RNA
caaggaagatggca

SEQ ID NO: 1226 - RNA, 14 nt, synthetic construct
  misc_feature 1..14: note = Description of Artificial Sequence: Synthetic oligonucleotide
  source 1..14: mol_type = other RNA
aaggaagatggcat

SEQ ID NO: 1227 - RNA, 14 nt, synthetic construct
  misc_feature 1..14: note = Description of Artificial Sequence: Synthetic oligonucleotide
  source 1..14: mol_type = other RNA
ggaagatggcattt

SEQ ID NO: 1228 - RNA, 14 nt, synthetic construct
  misc_feature 1..14: note = Description of Artificial Sequence: Synthetic oligonucleotide
  source 1..14: mol_type = other RNA
gaagatggcatttc

SEQ ID NO: 1229 - RNA, 14 nt, synthetic construct
  misc_feature 1..14: note = Description of Artificial Sequence: Synthetic oligonucleotide
  source 1..14: mol_type = other RNA
aagatggcatttct

SEQ ID NO: 1230 - RNA, 20 nt, synthetic construct
  misc_feature 1..20: note = Description of Artificial Sequence: Synthetic oligonucleotide
  source 1..20: mol_type = other RNA
tcaaggaagatggcatttct

SEQ ID NO: 1231 - RNA, 19 nt, synthetic construct
  misc_feature 1..19: note = Description of Artificial Sequence: Synthetic oligonucleotide
  source 1..19: mol_type = other RNA
tcaaggaagatggcatttc

SEQ ID NO: 1232 - RNA, 18 nt, synthetic construct
  misc_feature 1..18: note = Description of Artificial Sequence: Synthetic oligonucleotide
  source 1..18: mol_type = other RNA
tcaaggaagatggcattt

SEQ ID NO: 1233 - RNA, 19 nt, synthetic construct
  misc_feature 1..19: note = Description of Artificial Sequence: Synthetic oligonucleotide
  source 1..19: mol_type = other RNA
caaggaagatggcatttct

SEQ ID NO: 1234 - RNA, 20 nt, synthetic construct
  misc_feature 1..20: note = Description of Artificial Sequence: Synthetic oligonucleotide
  source 1..20: mol_type = other RNA
ggccaaacctcggcttacct

SEQ ID NO: 1235 - RNA, 20 nt, synthetic construct
  misc_feature 1..20: note = Description of Artificial Sequence: Synthetic oligonucleotide
  source 1..20: mol_type = other RNA
ggccaaacctcggcttacct

SEQ ID NO: 1236 - RNA, 20 nt, synthetic construct
  misc_feature 1..20: note = Description of Artificial Sequence: Synthetic oligonucleotide
  source 1..20: mol_type = other RNA
ttctgtaaggtttttatgtg

SEQ ID NO: 1237 - RNA, 20 nt, synthetic construct
  misc_feature 1..20: note = Description of Artificial Sequence: Synthetic oligonucleotide
  source 1..20: mol_type = other RNA
atttctgtaaggtttttatg

SEQ ID NO: 1238 - RNA, 20 nt, synthetic construct
  misc_feature 1..20: note = Description of Artificial Sequence: Synthetic oligonucleotide
  source 1..20: mol_type = other RNA
ccatttctgtaaggttttta

SEQ ID NO: 1239 - RNA, 20 nt, synthetic construct
  misc_feature 1..20: note = Description of Artificial Sequence: Synthetic oligonucleotide
  source 1..20: mol_type = other RNA
atccatttctgtaaggtttt

SEQ ID NO: 1240 - RNA, 20 nt, synthetic construct
  misc_feature 1..20: note = Description of Artificial Sequence: Synthetic oligonucleotide
  source 1..20: mol_type = other RNA
catccatttctgtaaggttt

SEQ ID NO: 1241 - RNA, 20 nt, synthetic construct
  misc_feature 1..20: note = Description of Artificial Sequence: Synthetic oligonucleotide
  source 1..20: mol_type = other RNA
ccatccatttctgtaaggtt

SEQ ID NO: 1242 - RNA, 20 nt, synthetic construct
  misc_feature 1..20: note = Description of Artificial Sequence: Synthetic oligonucleotide
  source 1..20: mol_type = other RNA
gccatccatttctgtaaggt

SEQ ID NO: 1243 - RNA, 20 nt, synthetic construct
  misc_feature 1..20: note = Description of Artificial Sequence: Synthetic oligonucleotide
  source 1..20: mol_type = other RNA
agccatccatttctgtaagg

SEQ ID NO: 1244 - RNA, 20 nt, synthetic construct
  misc_feature 1..20: note = Description of Artificial Sequence: Synthetic oligonucleotide
  source 1..20: mol_type = other RNA
cagccatccatttctgtaag

SEQ ID NO: 1245 - RNA, 20 nt, synthetic construct
  misc_feature 1..20: note = Description of Artificial Sequence: Synthetic oligonucleotide
  source 1..20: mol_type = other RNA
tcagccatccatttctgtaa

SEQ ID NO: 1246 - RNA, 20 nt, synthetic construct
  misc_feature 1..20: note = Description of Artificial Sequence: Synthetic oligonucleotide
  source 1..20: mol_type = other RNA
ttcagccatccatttctgta

SEQ ID NO: 1247 - RNA, 20 nt, synthetic construct
  misc_feature 1..20: note = Description of Artificial Sequence: Synthetic oligonucleotide
  source 1..20: mol_type = other RNA
cttcagccatccatttctgt

SEQ ID NO: 1248 - RNA, 20 nt, synthetic construct
  misc_feature 1..20: note = Description of Artificial Sequence: Synthetic oligonucleotide
  source 1..20: mol_type = other RNA
acttcagccatccatttctg

SEQ ID NO: 1249 - RNA, 20 nt, synthetic construct
  misc_feature 1..20: note = Description of Artificial Sequence: Synthetic oligonucleotide
  source 1..20: mol_type = other RNA
aacttcagccatccatttct

SEQ ID NO: 1250 - RNA, 20 nt, synthetic construct
  misc_feature 1..20: note = Description of Artificial Sequence: Synthetic oligonucleotide
  source 1..20: mol_type = other RNA
caacttcagccatccatttc

SEQ ID NO: 1251 - RNA, 20 nt, synthetic construct
  misc_feature 1..20: note = Description of Artificial Sequence: Synthetic oligonucleotide
  source 1..20: mol_type = other RNA
tcaacttcagccatccattt

SEQ ID NO: 1252 - RNA, 20 nt, synthetic construct
  misc_feature 1..20: note = Description of Artificial Sequence: Synthetic oligonucleotide
  source 1..20: mol_type = other RNA
atcaacttcagccatccatt

SEQ ID NO: 1253 - RNA, 20 nt, synthetic construct
  misc_feature 1..20: note = Description of Artificial Sequence: Synthetic oligonucleotide
  source 1..20: mol_type = other RNA
catcaacttcagccatccat

SEQ ID NO: 1254 - RNA, 20 nt, synthetic construct
  misc_feature 1..20: note = Description of Artificial Sequence: Synthetic oligonucleotide
  source 1..20: mol_type = other RNA
acatcaacttcagccatcca

SEQ ID NO: 1255 - RNA, 20 nt, synthetic construct
  misc_feature 1..20: note = Description of Artificial Sequence: Synthetic oligonucleotide
  source 1..20: mol_type = other RNA
aacatcaacttcagccatcc

SEQ ID NO: 1256 - RNA, 20 nt, synthetic construct
  misc_feature 1..20: note = Description of Artificial Sequence: Synthetic oligonucleotide
  source 1..20: mol_type = other RNA
gaaaacatcaacttcagcca

SEQ ID NO: 1257 - RNA, 20 nt, synthetic construct
  misc_feature 1..20: note = Description of Artificial Sequence: Synthetic oligonucleotide
  source 1..20: mol_type = other RNA
caggaaaacatcaacttcag

SEQ ID NO: 1258 - RNA, 20 nt, synthetic construct
  misc_feature 1..20: note = Description of Artificial Sequence: Synthetic oligonucleotide
  source 1..20: mol_type = other RNA
tttcaggaaaacatcaactt

SEQ ID NO: 1259 - RNA, 20 nt, synthetic construct
  misc_feature 1..20: note = Description of Artificial Sequence: Synthetic oligonucleotide
  source 1..20: mol_type = other RNA
ctctttcaggaaaacatcaa

SEQ ID NO: 1260 - RNA, 20 nt, synthetic construct
  misc_feature 1..20: note = Description of Artificial Sequence: Synthetic oligonucleotide
  source 1..20: mol_type = other RNA
ttcctctttcaggaaaacat

SEQ ID NO: 1261 - RNA, 20 nt, synthetic construct
  misc_feature 1..20: note = Description of Artificial Sequence: Synthetic oligonucleotide
  source 1..20: mol_type = other RNA
gccattcctctttcaggaaa

SEQ ID NO: 1262 - RNA, 20 nt, synthetic construct
  misc_feature 1..20: note = Description of Artificial Sequence: Synthetic oligonucleotide
  source 1..20: mol_type = other RNA
ggccattcctctttcaggaa

SEQ ID NO: 1263 - RNA, 20 nt, synthetic construct
  misc_feature 1..20: note = Description of Artificial Sequence: Synthetic oligonucleotide
  source 1..20: mol_type = other RNA
aggccattcctctttcagga

SEQ ID NO: 1264 - RNA, 20 nt, synthetic construct
  misc_feature 1..20: note = Description of Artificial Sequence: Synthetic oligonucleotide
  source 1..20: mol_type = other RNA
caggccattcctctttcagg

SEQ ID NO: 1265 - RNA, 20 nt, synthetic construct
  misc_feature 1..20: note = Description of Artificial Sequence: Synthetic oligonucleotide
  source 1..20: mol_type = other RNA
gcaggccattcctctttcag

SEQ ID NO: 1266 - RNA, 20 nt, synthetic construct
  misc_feature 1..20: note = Description of Artificial Sequence: Synthetic oligonucleotide
  source 1..20: mol_type = other RNA
ggcaggccattcctctttca

SEQ ID NO: 1267 - RNA, 20 nt, synthetic construct
  misc_feature 1..20: note = Description of Artificial Sequence: Synthetic oligonucleotide
  source 1..20: mol_type = other RNA
gggcaggccattcctctttc

SEQ ID NO: 1268 - RNA, 20 nt, synthetic construct
  misc_feature 1..20: note = Description of Artificial Sequence: Synthetic oligonucleotide
  source 1..20: mol_type = other RNA
agggcaggccattcctcttt

SEQ ID NO: 1269 - RNA, 20 nt, synthetic construct
  misc_feature 1..20: note = Description of Artificial Sequence: Synthetic oligonucleotide
  source 1..20: mol_type = other RNA
cagggcaggccattcctctt

SEQ ID NO: 1270 - RNA, 20 nt, synthetic construct
  misc_feature 1..20: note = Description of Artificial Sequence: Synthetic oligonucleotide
  source 1..20: mol_type = other RNA
ccagggcaggccattcctct

SEQ ID NO: 1271 - RNA, 20 nt, synthetic construct
  misc_feature 1..20: note = Description of Artificial Sequence: Synthetic oligonucleotide
  source 1..20: mol_type = other RNA
cccagggcaggccattcctc

SEQ ID NO: 1272 - RNA, 20 nt, synthetic construct
  misc_feature 1..20: note = Description of Artificial Sequence: Synthetic oligonucleotide
  source 1..20: mol_type = other RNA
ccccagggcaggccattcct

SEQ ID NO: 1273 - RNA, 20 nt, synthetic construct
  misc_feature 1..20: note = Description of Artificial Sequence: Synthetic oligonucleotide
  source 1..20: mol_type = other RNA
cccccagggcaggccattcc

SEQ ID NO: 1274 - RNA, 20 nt, synthetic construct
  misc_feature 1..20: note = Description of Artificial Sequence: Synthetic oligonucleotide
  source 1..20: mol_type = other RNA
tcccccagggcaggccattc

SEQ ID NO: 1275 - RNA, 20 nt, synthetic construct
  misc_feature 1..20: note = Description of Artificial Sequence: Synthetic oligonucleotide
  source 1..20: mol_type = other RNA
atcccccagggcaggccatt

SEQ ID NO: 1276 - RNA, 20 nt, synthetic construct
  misc_feature 1..20: note = Description of Artificial Sequence: Synthetic oligonucleotide
  source 1..20: mol_type = other RNA
catcccccagggcaggccat

SEQ ID NO: 1277 - RNA, 20 nt, synthetic construct
  misc_feature 1..20: note = Description of Artificial Sequence: Synthetic oligonucleotide
  source 1..20: mol_type = other RNA
gcatcccccagggcaggcca

SEQ ID NO: 1278 - RNA, 20 nt, synthetic construct
  misc_feature 1..20: note = Description of Artificial Sequence: Synthetic oligonucleotide
  source 1..20: mol_type = other RNA
agcatcccccagggcaggcc

SEQ ID NO: 1279 - RNA, 20 nt, synthetic construct
  misc_feature 1..20: note = Description of Artificial Sequence: Synthetic oligonucleotide
  source 1..20: mol_type = other RNA
cagcatcccccagggcaggc

SEQ ID NO: 1280 - RNA, 20 nt, synthetic construct
  misc_feature 1..20: note = Description of Artificial Sequence: Synthetic oligonucleotide
  source 1..20: mol_type = other RNA
tcagcatcccccagggcagg

SEQ ID NO: 1281 - RNA, 20 nt, synthetic construct
  misc_feature 1..20: note = Description of Artificial Sequence: Synthetic oligonucleotide
  source 1..20: mol_type = other RNA
ttcagcatcccccagggcag

SEQ ID NO: 1282 - RNA, 20 nt, synthetic construct
  misc_feature 1..20: note = Description of Artificial Sequence: Synthetic oligonucleotide
  source 1..20: mol_type = other RNA
tttcagcatcccccagggca

SEQ ID NO: 1283 - RNA, 20 nt, synthetic construct
  misc_feature 1..20: note = Description of Artificial Sequence: Synthetic oligonucleotide
  source 1..20: mol_type = other RNA
atttcagcatcccccagggc

SEQ ID NO: 1284 - RNA, 20 nt, synthetic construct
  misc_feature 1..20: note = Description of Artificial Sequence: Synthetic oligonucleotide
  source 1..20: mol_type = other RNA
gatttcagcatcccccaggg

SEQ ID NO: 1285 - RNA, 20 nt, synthetic construct
  misc_feature 1..20: note = Description of Artificial Sequence: Synthetic oligonucleotide
  source 1..20: mol_type = other RNA
ggatttcagcatcccccagg

SEQ ID NO: 1286 - RNA, 20 nt, synthetic construct
  misc_feature 1..20: note = Description of Artificial Sequence: Synthetic oligonucleotide
  source 1..20: mol_type = other RNA
aggatttcagcatcccccag

SEQ ID NO: 1287 - RNA, 20 nt, synthetic construct
  misc_feature 1..20: note = Description of Artificial Sequence: Synthetic oligonucleotide
  source 1..20: mol_type = other RNA
caggatttcagcatccccca

SEQ ID NO: 1288 - RNA, 20 nt, synthetic construct
  misc_feature 1..20: note = Description of Artificial Sequence: Synthetic oligonucleotide
  source 1..20: mol_type = other RNA
tcaggatttcagcatccccc

SEQ ID NO: 1289 - RNA, 20 nt, synthetic construct
  misc_feature 1..20: note = Description of Artificial Sequence: Synthetic oligonucleotide
  source 1..20: mol_type = other RNA
ttcaggatttcagcatcccc

SEQ ID NO: 1290 - RNA, 20 nt, synthetic construct
  misc_feature 1..20: note = Description of Artificial Sequence: Synthetic oligonucleotide
  source 1..20: mol_type = other RNA
tttcaggatttcagcatccc

SEQ ID NO: 1291 - RNA, 20 nt, synthetic construct
  misc_feature 1..20: note = Description of Artificial Sequence: Synthetic oligonucleotide
  source 1..20: mol_type = other RNA
ttttcaggatttcagcatcc

SEQ ID NO: 1292 - RNA, 20 nt, synthetic construct
  misc_feature 1..20: note = Description of Artificial Sequence: Synthetic oligonucleotide
  source 1..20: mol_type = other RNA
tttttcaggatttcagcatc

SEQ ID NO: 1293 - RNA, 20 nt, synthetic construct
  misc_feature 1..20: note = Description of Artificial Sequence: Synthetic oligonucleotide
  source 1..20: mol_type = other RNA
ttttttcaggatttcagcat

SEQ ID NO: 1294 - RNA, 20 nt, synthetic construct
  misc_feature 1..20: note = Description of Artificial Sequence: Synthetic oligonucleotide
  source 1..20: mol_type = other RNA
gttttttcaggatttcagca

SEQ ID NO: 1295 - RNA, 20 nt, synthetic construct
  misc_feature 1..20: note = Description of Artificial Sequence: Synthetic oligonucleotide
  source 1..20: mol_type = other RNA
tgttttttcaggatttcagc

SEQ ID NO: 1296 - RNA, 20 nt, synthetic construct
  misc_feature 1..20: note = Description of Artificial Sequence: Synthetic oligonucleotide
  source 1..20: mol_type = other RNA
ctgttttttcaggatttcag

SEQ ID NO: 1297 - RNA, 20 nt, synthetic construct
  misc_feature 1..20: note = Description of Artificial Sequence: Synthetic oligonucleotide
  source 1..20: mol_type = other RNA
gctgttttttcaggatttca

SEQ ID NO: 1298 - RNA, 20 nt, synthetic construct
  misc_feature 1..20: note = Description of Artificial Sequence: Synthetic oligonucleotide
  source 1..20: mol_type = other RNA
agctgttttttcaggatttc

SEQ ID NO: 1299 - RNA, 20 nt, synthetic construct
  misc_feature 1..20: note = Description of Artificial Sequence: Synthetic oligonucleotide
  source 1..20: mol_type = other RNA
gagctgttttttcaggattt

SEQ ID NO: 1300 - RNA, 20 nt, synthetic construct
  misc_feature 1..20: note = Description of Artificial Sequence: Synthetic oligonucleotide
  source 1..20: mol_type = other RNA
tgagctgttttttcaggatt

SEQ ID NO: 1301 - RNA, 20 nt, synthetic construct
  misc_feature 1..20: note = Description of Artificial Sequence: Synthetic oligonucleotide
  source 1..20: mol_type = other RNA
ttgagctgttttttcaggat

SEQ ID NO: 1302 - RNA, 20 nt, synthetic construct
  misc_feature 1..20: note = Description of Artificial Sequence: Synthetic oligonucleotide
  source 1..20: mol_type = other RNA
tttgagctgttttttcagga

SEQ ID NO: 1303 - RNA, 20 nt, synthetic construct
  misc_feature 1..20: note = Description of Artificial Sequence: Synthetic oligonucleotide
  source 1..20: mol_type = other RNA
gtttgagctgttttttcagg

SEQ ID NO: 1304 - RNA, 20 nt, synthetic construct
  misc_feature 1..20: note = Description of Artificial Sequence: Synthetic oligonucleotide
  source 1..20: mol_type = other RNA
ttgtttgagctgttttttca

SEQ ID NO: 1305 - RNA, 20 nt, synthetic construct
  misc_feature 1..20: note = Description of Artificial Sequence: Synthetic oligonucleotide
  source 1..20: mol_type = other RNA
cattgtttgagctgtttttt

SEQ ID NO: 1306 - RNA, 20 nt, synthetic construct
  misc_feature 1..20: note = Description of Artificial Sequence: Synthetic oligonucleotide
  source 1..20: mol_type = other RNA
gcattgtttgagctgttttt

SEQ ID NO: 1307 - RNA, 20 nt, synthetic construct
  misc_feature 1..20: note = Description of Artificial Sequence: Synthetic oligonucleotide
  source 1..20: mol_type = other RNA
tgcattgtttgagctgtttt

SEQ ID NO: 1308 - RNA, 20 nt, synthetic construct
  misc_feature 1..20: note = Description of Artificial Sequence: Synthetic oligonucleotide
  source 1..20: mol_type = other RNA
ctgcattgtttgagctgttt

SEQ ID NO: 1309 - RNA, 20 nt, synthetic construct
  misc_feature 1..20: note = Description of Artificial Sequence: Synthetic oligonucleotide
  source 1..20: mol_type = other RNA
tctgcattgtttgagctgtt

SEQ ID NO: 1310 - RNA, 20 nt, synthetic construct
  misc_feature 1..20: note = Description of Artificial Sequence: Synthetic oligonucleotide
  source 1..20: mol_type = other RNA
ctctgcattgtttgagctgt

SEQ ID NO: 1311 - RNA, 20 nt, synthetic construct
  misc_feature 1..20: note = Description of Artificial Sequence: Synthetic oligonucleotide
  source 1..20: mol_type = other RNA
actctgcattgtttgagctg

SEQ ID NO: 1312 - RNA, 20 nt, synthetic construct
  misc_feature 1..20: note = Description of Artificial Sequence: Synthetic oligonucleotide
  source 1..20: mol_type = other RNA
tactctgcattgtttgagct

SEQ ID NO: 1313 - RNA, 20 nt, synthetic construct
  misc_feature 1..20: note = Description of Artificial Sequence: Synthetic oligonucleotide
  source 1..20: mol_type = other RNA
ttactctgcattgtttgagc

SEQ ID NO: 1314 - RNA, 20 nt, synthetic construct
  misc_feature 1..20: note = Description of Artificial Sequence: Synthetic oligonucleotide
  source 1..20: mol_type = other RNA
cttactctgcattgtttgag

SEQ ID NO: 1315 - RNA, 20 nt, synthetic construct
  misc_feature 1..20: note = Description of Artificial Sequence: Synthetic oligonucleotide
  source 1..20: mol_type = other RNA
tcttactctgcattgtttga

SEQ ID NO: 1316 - RNA, 20 nt, synthetic construct
  misc_feature 1..20: note = Description of Artificial Sequence: Synthetic oligonucleotide
  source 1..20: mol_type = other RNA
atcttactctgcattgtttg

SEQ ID NO: 1317 - RNA, 20 nt, synthetic construct
  misc_feature 1..20: note = Description of Artificial Sequence: Synthetic oligonucleotide
  source 1..20: mol_type = other RNA
aatcttactctgcattgttt

SEQ ID NO: 1318 - RNA, 20 nt, synthetic construct
  misc_feature 1..20: note = Description of Artificial Sequence: Synthetic oligonucleotide
  source 1..20: mol_type = other RNA
caaatcttactctgcattgt

SEQ ID NO: 1319 - RNA, 20 nt, synthetic construct
  misc_feature 1..20: note = Description of Artificial Sequence: Synthetic oligonucleotide
  source 1..20: mol_type = other RNA
gatacaaatcttactctgca

SEQ ID NO: 1320 - DNA, 20 bp, synthetic construct
  misc_feature 1..20: note = Description of Artificial Sequence: Synthetic oligonucleotide
  source 1..20: mol_type = other DNA
gggtcagctgccaatgctag

SEQ ID NO: 1321 - DNA, 20 bp, synthetic construct
  misc_feature 1..20: note = Description of Artificial Sequence: Synthetic oligonucleotide
  source 1..20: mol_type = other DNA
gggtcagctgccaatgctag

SEQ ID NO: 1322 - DNA, 20 bp, synthetic construct
  misc_feature 1..20: note = Description of Artificial Sequence: Synthetic oligonucleotide
  source 1..20: mol_type = other DNA
gggtcagctgccaatgctag

SEQ ID NO: 1323 - DNA, 20 bp, synthetic construct
  misc_feature 1..20: note = Description of Artificial Sequence: Synthetic oligonucleotide
  source 1..20: mol_type = other DNA
gggtcagctgccaatgctag

SEQ ID NO: 1324 - DNA, 20 bp, synthetic construct
  misc_feature 1..20: note = Description of Artificial Sequence: Synthetic oligonucleotide
  source 1..20: mol_type = other DNA
gggtcagctgccaatgctag

The invention claimed is:

1. A method for skipping exon 51 of dystrophin, comprising administering an oligonucleotide composition comprising a first plurality of oligonucleotides of a particular oligonucleotide type defined by:

1) base sequence;
2) pattern of backbone linkages;
3) pattern of backbone chiral centers; and
4) pattern of backbone phosphorus modifications, which composition is chirally controlled in that it is enriched, relative to a substantially racemic preparation of oligonucleotides having the same base sequence, for oligonucleotides of the particular oligonucleotide type, wherein:

oligonucleotides of particular oligonucleotide type each comprise:

1) a 5'-end region comprising 2 or more consecutive nucleoside units each comprising a 2'-F modified sugar moiety;
2) a 3'-end region comprising 2 or more consecutive nucleoside units each comprising a 2'-F modified sugar moiety; and
3) a middle region between the 5'-end region and the 3'-region comprising at least one 2'-$OR^1$ modified sugar moiety and at least one 2'-F modified sugar moiety, wherein $R^1$ is optionally substituted $C_{1-6}$ alkyl; and oligonucleotides of the particular oligonucleotide type are capable of mediating the skipping of exon 51 of the dystrophin gene.

2. The method of claim 1, wherein the pattern of backbone linkages comprises one or more backbone linkages selected from phosphodiester, phosphorothioate and phosphodithioate linkages.

3. The method of claim 2, wherein about 50% or more of the sugar moieties in each oligonucleotide of the first plurality are modified sugar moieties.

4. The method of claim 3, wherein each sugar moiety in each oligonucleotide of the first plurality is independently modified, wherein each sugar modification is independently 2'-$OR^1$ or 2'-F, wherein $R^1$ is optionally substituted $C_{1-6}$ alkyl.

7. A method for treating Duchenne muscular dystrophy, comprising administering to a subject susceptible thereto or suffering therefrom an oligonucleotide composition comprising a first plurality of oligonucleotides of a particular oligonucleotide type defined by:

1) base sequence;
2) pattern of backbone linkages;
3) pattern of backbone chiral centers; and
4) pattern of backbone phosphorus modifications, which composition is chirally controlled in that it is enriched, relative to a substantially racemic preparation of oligonucleotides having the same base sequence, for oligonucleotides of the particular oligonucleotide type, wherein:

oligonucleotides of particular oligonucleotide type each comprise:

1) a 5'-end region comprising 2 or more consecutive nucleoside units each comprising a 2'-F modified sugar moiety;
2) a 3'-end region comprising 2 or more consecutive nucleoside units each comprising a 2'-F modified sugar moiety; and
3) a middle region between the 5'-end region and the 3'-region comprising at least one 2'-$OR^1$ modified sugar moiety and at least one 2'-F modified sugar moiety, wherein $R^1$ is optionally substituted $C_{1-6}$ alkyl; and oligonucleotides of the particular oligonucleotide type are capable of mediating the skipping of exon 51 of the dystrophin gene.

8. The method of claim 7, wherein the pattern of backbone linkages comprises one or more backbone linkages selected from phosphodiester, phosphorothioate and phosphodithioate linkages.

9. The method of claim 8, wherein about 50% or more of the sugar moieties in each oligonucleotide of the first plurality are modified sugar moieties.

10. The method of claim 9, wherein each sugar moiety in each oligonucleotide of the first plurality is independently modified, wherein each sugar modification is independently 2'-$OR^1$ or 2'-F, wherein $R^1$ is optionally substituted $C_{1-6}$ alkyl.

11. The method of claim 7, wherein the base sequence comprises a sequence having no more than 5 mismatches from a 20 base long portion of the dystrophin gene or its complement, the length is no more than 50 bases, and the pattern of backbone chiral centers comprises at least three chirally controlled centers independently of Rp or Sp.

12. The method of claim 7, wherein at least 10% of the oligonucleotides that have the base sequence of the particular oligonucleotide type are oligonucleotides of the particular oligonucleotide type.

* * * * *